United States Patent 11,098,302 (IDENTIFICATION OF POLYNUCLEOTIDES ASSOCIATED WITH A SAMPLE) - sequence listing, part 146

SEQ ID NO: 555375 - DNA, 485 bp, Homo sapiens
  misc_feature: HIJSMM301ANJMK.52.59.F04.1.454.light.4.raw
cgcagtacgacacgaccggtgctcgatttagtacacacacttagggattggggagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaactatttaaattggtatcagcagaaaccagggaaagcccctaaactcctgatctacgatgcatccaatttggagacaggggtcccatcaaggttcactggaagtggatctgggacacattttactttcaccatcagcggcctgcagcctgaagattttgcaacatattactgtcaacaatatgaagatctccccctcactttcgcggagggaccaaggtggagatcagacgaactgtggctgcaccatctgtctt

SEQ ID NO: 555376 - DNA, 487 bp, Homo sapiens; identical to SEQ ID NO: 546036
  misc_feature: HIJSMM301CCR6C.8.12.B01.1.454.light.4.raw

SEQ ID NO: 555377 - DNA, 444 bp, Homo sapiens; identical to SEQ ID NO: 535027
  misc_feature: HIJSMM301EQ43W.8.73.G07.1.454.light.4.raw

SEQ ID NO: 555378 - DNA, 492 bp, Homo sapiens
  misc_feature: HIJSMM301DY2X1.49.55.E11.1.454.light.4.raw
agtcgagagacacgaccggtgctcgatttagcactcgcacgttgggtttgggggaggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgggacagacttcactctcaccatcagcagcctagagcctgaagattttgcagtctattactgtcagcagcgttacaactggcctcccatgtacacttttggccaggggaccaagctggaaatcagacgaactgtggctgcaccat

SEQ ID NO: 555379 - DNA, 447 bp, Homo sapiens; identical to SEQ ID NO: 535201
  misc_feature: HIJSMM301DTT7L.18.9.A09.1.454.light.4.raw

SEQ ID NO: 555380 - DNA, 498 bp, Homo sapiens
  misc_feature: HIJSMM301BGK7T.13.6.A06.1.454.light.4.raw
tcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcgggcctccggggtccctaacaggttcagtggcagtggatcaggcacagattttacactgaaaatcagcagagtggaggctgaggatgttggggtttattactgcatgcaagctctacaacctctgcggactttcggcctcgggaccgaaagtaggagagtcaaacgaactagtggctgcaccatctgtctt

SEQ ID NO: 555381 - DNA, 506 bp, Homo sapiens
  misc_feature: HIJSMM301C3GLW.4.21.B10.1.454.light.4.raw
agcactgtagcacgaccggtgctcgatttagtgtcgtcgcaagagagagaggaggggggggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaaatatgcttattggtaccagcagaagtcaggccaggccccaaaattggtcatctatgaagacgacaaacgaccctccgggatccctgagagattctctggctccagctcagggactatggccaccttgactatcagtgggcccaagtggaggatgaagctgactactactgttactcaatagagaacagtgataatttctgggtgttcggcggagggaccaaactgaccgtcctaggtcagcccaaggctgccccctcggtcactctcg

SEQ ID NO: 555382 - DNA, 493 bp, Homo sapiens
  misc_feature: HIJSMM301A8P0B.49.28.C06.1.454.light.4.raw
agtcgagagacacgaccggtgctcgatttagagctcacgtattgggtttgggggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgggacagacttcactctcaccatcagcagcctagagcctgaagattttgcagtctattactgtcagcagcgttacaactggcctcccatgtacacttttggccaggggaccaagctggaaatcagacgaactgtggctgcaccatctgt

SEQ ID NO: 555383 - DNA, 513 bp, Homo sapiens; identical to SEQ ID NO: 535244
  misc_feature: HIJSMM301A70P0.17.33.C11.1.454.light.4.raw

SEQ ID NO: 555384 - DNA, 505 bp, Homo sapiens
  misc_feature: HIJSMM301DC9TV.7.59.F04.1.454.light.4.raw
  modified_base (499)..(499): a, c, t, g, unknown or other
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtggacagtccaaggatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttaatccgttggacgttcggccaaggaccgagggtgggaaatacaaacgaaactagtggctgcaccatctgtnttctat

SEQ ID NO: 555385 - DNA, 487 bp, Homo sapiens; identical to SEQ ID NO: 538190
  misc_feature: HIJSMM301BX02X.47.70.G04.1.454.light.4.raw

SEQ ID NO: 555386 - DNA, 485 bp, Homo sapiens
  misc_feature: HIJSMM301B6MZ6.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtgaggctgaggatgttggggtttattactgcatgcaagtctacaaacttcctacacttttggccaggggaccaagctggagatcaaacgaa

SEQ ID NO: 555387 - DNA, 490 bp, Homo sapiens; identical to SEQ ID NO: 535234
  misc_feature: HIJSMM301CQHME.17.21.B10.1.454.light.4.raw

SEQ ID NO: 555388 - DNA, 491 bp, Homo sapiens
  misc_feature: HIJSMM301CFHUI.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcacttatgtcttcggaactgggaccaaggtcaccgacctaggtcagcccaagg

SEQ ID NO: 555389 - DNA, 508 bp, Homo sapiens
  misc_feature: HIJSMM301AK1DG.8.42.D09.1.454.light.4.raw
ctcgcgtgtccacgaccggtgctcgatttagacacatacgcagggaaaggggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcggcggagggaccaagttgaccgtcctaggtcagcccaaggctgccccctggtcactctgttcccaccct

SEQ ID NO: 555390 - DNA, 473 bp, Homo sapiens; identical to SEQ ID NO: 541215
  misc_feature: HIJSMM301A3JNM.13.48.E04.1.454.light.4.raw

SEQ ID NO: 555391 - DNA, 499 bp, Homo sapiens; identical to SEQ ID NO: 536187
  misc_feature: HIJSMM301B3734.11.67.G01.1.454.light.4.raw

SEQ ID NO: 555392 - DNA, 497 bp, Homo sapiens
  misc_feature: HIJSMM301AX2D0.43.71.G05.1.454.light.4.raw
tgtgagtagtcacgaccggtgctcgatttagtgtcgtcgcaagagagaggggggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttc

SEQ ID NO: 555393 - DNA, 384 bp, Homo sapiens
  misc_feature: HIJSMM301C7DH3.48.87.H10.1.454.light.4.raw
agtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcacca

SEQ ID NO: 555394 - DNA, 507 bp, Homo sapiens; identical to SEQ ID NO: 547790
  misc_feature: HIJSMM301BV8LA.21.87.H10.1.454.light.4.raw

SEQ ID NO: 555395 - DNA, 501 bp, Homo sapiens; identical to SEQ ID NO: 536867
  misc_feature: HIJSMM301BHAL2.5.86.H09.1.454.light.4.raw

SEQ ID NO: 555396 - DNA, 445 bp, Homo sapiens; identical to SEQ ID NO: 536070
  misc_feature: HIJSMM301A4QVD.5.9.A09.1.454.light.4.raw

SEQ ID NO: 555397 - DNA, 376 bp, Homo sapiens
  misc_feature: HIJSMM301CIZ4E.11.60.F05.1.454.light.4.raw
cgagagataccacgaccggtgctcgatttagtacgtcatcaggggaaagggccaccctctcctgcagggccagtcagagtattagcagcaacttagcctggtaccaacaaaacctggccaggctcccaggctcctcttctatggtgcatccaacagggccgctggtatcccagccaggttcagtggcagtgggtctgcgacagagttcactctcaccatcagcagtctgcagtctgaagattttgcagtttattactgtcagcagtataatgactggcctcccacgtggacgttcggccaagggaccaaggtggaaatcaaacgaactgtggctgcaccatctgtcttcatcttcccgccatctgagtatctctcg

SEQ ID NO: 555398 - DNA, 500 bp, Homo sapiens
  misc_feature: HIJSMM301EK6VU.43.41.D08.1.454.light.4.raw
tgtgagtagtcacgaccggtgctcgatttagtcacgcgagaaagggaaagggggagctacaacaggcaggcaggggcagcaagatggtgttgcagacccaggtcttcatttctctgttgctctggatctctggtgcctacggggacgtcgtgatgacccagtctccagactccctggcagtgtctcgtgggcgggagggccaccatcaactgcaagtccagccagagtattttatacagctcctacaataagagcgacttagcttggtaccagcagaaaccaggacagcctcctaagttgctcatttactgggcatctaaccggcaatccggggtccctgaccgattcagtggcagcgggtctgggacacatttcgctttcaccatcagcagcctgcaggctgaggatgtggcagtttattactgtcagcaatattatactactccgtggactttcggccaagggaccaaggtggaaatcagacgaactgtggctgcacc

SEQ ID NO: 555399 - DNA, 488 bp, Homo sapiens; identical to SEQ ID NO: 539612
  misc_feature: HIJSMM301BTRUB.3.55.E11.1.454.light.4.raw

SEQ ID NO: 555400 - DNA, 508 bp, Homo sapiens
  misc_feature: HIJSMM301ANPOU.48.30.C08.1.454.light.4.raw
agtatacatacacgaccggtgctcgatttagtctgacgtcaaagggaaagggggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagtttacgtcggacctcgtcgacggacgacgactgagagtaaacgtaactactggtgtgtcaccactactcgtcttctctacttcccgt

SEQ ID NO: 555401 - DNA, 515 bp, Homo sapiens
  misc_feature: HIJSMM301AGPL0.15.34.D01.1.454.light.4.raw
tctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtggggcgtggcatttgggtgttcggcggagggaccaaactgaccgtcctaggtcagcccaaggctgccccctcggtcactctcg

SEQ ID NO: 555402 - DNA, 455 bp, Homo sapiens
  misc_feature: HIJSMM301B8JY9.5.86.H09.1.454.light.4.raw
atcagacacgcacgaccggtgctcgatttagtgctatagacttgggtttggggggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaagctgaccgtcctaggtcagcccaaggctgccccctcggtcactctgttcccgccctcctccgtgtctgat

SEQ ID NO: 555403 - DNA, 485 bp, Homo sapiens
  misc_feature: HIJSMM301AGO8L.8.12.B01.1.454.light.4.raw
ctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattggggataaatatgcttgctggtatcagcagaggccaggccagtcccctgtactggtcatctatcaagataacaagcggccctcagggatccctgagcgattctctggctccaactctgggaacacagccactctgaccatcagcgggacccaggctacggatgaggctgactattactgtcaggcgtgggacagcagcacctatgtggttttcggcggagggaccaagctgaccgtccttggtcagcccaaggctgccccc

SEQ ID NO: 555404 - DNA, 510 bp, Homo sapiens; identical to SEQ ID NO: 545590
  misc_feature: HIJSMM301DDZT8.7.34.D01.1.454.light.4.raw

SEQ ID NO: 555405 - DNA, 505 bp, Homo sapiens
  misc_feature: HIJSMM301CGMMV.15.59.F04.1.454.light.4.raw
tctacgtagccacgaccggtgctcgatttagtacacacacttagggattggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctgggtccctgatcgcttctctggctccatccttggaaacaaagctgccctcaccatcacgggggcccaggcagatgatgaatctgtttattattgtgtcctatatatgggtgctggcatttcggtcttcggcggagggaccaagctgaccgtcctaggtcagcccaaggctgccccctcggt

SEQ ID NO: 555406 - DNA, 484 bp, Homo sapiens; identical to SEQ ID NO: 537878
  misc_feature: HIJSMM301DX361.17.34.D01.1.454.light.4.raw

SEQ ID NO: 555407 - DNA, 460 bp, Homo sapiens
  misc_feature: HIJSMM301BH6WJ.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgatcgattctctggctctaagtctggcacctcggcctccctggacatcagtggcctccggtccgaggatgaggctgattattactgtgcagcatgggattacaacctgagtgatcctagttgggtgttcggcggagggaccaggctgaccgtcctaggtcagcccaaggctgccccctcggtcactctgttcccaccctcctcacgcgtatgt

SEQ ID NO: 555408 - DNA, 496 bp, Homo sapiens; identical to SEQ ID NO: 553382
  misc_feature: HIJSMM301DSEPS.51.59.F04.1.454.light.4.raw

SEQ ID NO: 555409 - DNA, 493 bp, Homo sapiens
  misc_feature: HIJSMM301AJ59R.40.33.C11.1.454.light.4.raw
tctagcgactcacgaccggtgctcgatttagagtgagctcgttgggtttggggagctgggaagcctgagaacacttggccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagaccccaggccagcctccacgttcactcatcgtcagcacaagcagacgtttgcctggggtgcctgatcgcttctctgcctccatccttgggaacaaagctgccctcaccattacgggggcccagccagaggatgagtcttattattactgcatgctccatgtgggggtgccacttgggtgttcggcggagggaccaagctgaccgtcctaggtcagccc

SEQ ID NO: 555410 - DNA, 499 bp, Homo sapiens
  misc_feature: HIJSMM301CMUZK.48.1.A01.1.454.light.4.raw
agtatacatacacgaccggtgctcgatttagacgtctcatcagggggcaggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagcccgaagctcctaattttcgctgtctccagtttgcagagtggagtcccatctcggttcagcggcagtggatctggggcagagttcattctcaccatcaacagccttcagcctgaagattttgcaacttactattgtcagcagggtgactacgtttccctccctactttcggcgggagggaccgacgggtggacgtcgaaacgaactgtggctgcacatctgtcttcattcc

SEQ ID NO: 555411 - DNA, 507 bp, Homo sapiens
  misc_feature: HIJSMM301BHZPM.4.10.A10.1.454.light.4.raw
agcactgtagcacgaccggtgctcgatttagcgtcgatctcaggggggggtagagaagacaggactcaggacaatctccagcatggccagcttccctctcctcctcaccctcctcactcactgtgcagggtcctgggcccactctgtgctgactcagccaccctcagcgtctgggacccccgggcagagggtcaccatctcttgttctggaagcacctccaacatcggaagtaatcctgtaaactggttccagcaactcccaggaagggcccccaaagtcctcatctatggtcagaatcagcgtccctcaggggtccctgaccgattctctggctccaagtctgacacctcagcctccctggccatcagtgggctccagtctgaggatgaggctgattattactgtgcaacatgggatgacatcctacgtggtgcggtgttcggcggagggaccaagttgaccgtcctgggtcagcccaaggctgccccctggtcactctgttccca

SEQ ID NO: 555412 - DNA, 486 bp, Homo sapiens; identical to SEQ ID NO: 538674
  misc_feature: HIJSMM301CY4V5.47.38.D05.1.454.light.4.raw

SEQ ID NO: 555413 - DNA, 507 bp, Homo sapiens; identical to SEQ ID NO: 542586
  misc_feature: HIJSMM301ANXCM.8.33.C11.1.454.light.4.raw

SEQ ID NO: 555414 - DNA, 491 bp, Homo sapiens
  misc_feature: HIJSMM301DKWPU.19.10.A10.1.454.light.4.raw
tactctcgtgcacgaccggtgctcgatttagcgtcgatctcaggggcagagctctggagaagagctgctcagttaggacccagagggaaccatggaaaccccagcgcagcttctcttcctcctgctactctggctcccagatagcaccggagaaattttcttgacgcagtctccaggcaccctgtctttgacccctggggaaagagccaccctctcctgcagggccgataagagtgttgacagcaccttctttgcctggtaccagcagagacctgccaggctcccaggctcctcgtttatggtgcgtccaccagggccactggcatccccgacaggttcagtggcagtgtgtctgggacagacttcactctcaccatcagcagactggagcctgaagattttgcagtgtattactgtcaacgatatgatgagtcacctccgtggtggacatttggccaggggaccaaggttgaagtcaaacgaaactgtgg

SEQ ID NO: 555415 - DNA, 494 bp, Homo sapiens
  misc_feature: HIJSMM301EJYFE.8.53.E09.1.454.light.4.raw
ctcgcgtgtccacgaccggtgctcgatttagagagagtgtgttgggtttggggggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctcg

SEQ ID NO: 555416 - DNA, 490 bp, Homo sapiens; identical to SEQ ID NO: 535234
  misc_feature: HIJSMM301B6AOU.17.21.B10.1.454.light.4.raw

SEQ ID NO: 555417 - DNA, 503 bp, Homo sapiens
  misc_feature: HIJSMM301EYERP.18.11.A11.1.454.light.4.raw
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaaatactatagtcctcctctcacgttcggcggagggaccaaggtggagatcaaaacgaactgtggctgcaccatctgtctt

SEQ ID NO: 555418 - DNA, 512 bp, Homo sapiens
  misc_feature: HIJSMM301A7H91.48.14.B03.1.454.light.4.raw
agtatacatacacgaccggtgctcgatttagtgtgagtagttccgcggggactgatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaagtaaaaatggaaacatttacttacattggtttcaacagaggccaggccagtctccaaggcgcctgatttatgacgtttttaaacgggagtctggggtcccagacagattcagcggcagtgggtcagacactgacttcacactgagaatcagcagggttgaggctgaggatgttggcacttattactgcatgcaaggctcacactggcctccgtggacgttcggccaagggacccgggtggaaataaaacgaactagtggctgcaccatctgtcttcta

SEQ ID NO: 555419 - DNA, 506 bp, Homo sapiens
  misc_feature: HIJSMM301CC1IZ.48.57.F02.1.454.light.4.raw
agtatacatacacgaccggtgctcgatttagctcgatatagttgggtttggggaggaactgctcagttaggacccagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggctcctcatttatgatacatccaccagggccactggtgtcccagccaggttcactgggcggtgggtctgggacagagttcactctcaccatcagcagcctgcagtctgaagtattttacattttattactgtcagcagtatcgtaagtggactccgacgtttggccaagggaccaaggtggaatcaaacgactgtggctgcaccatctgtcttcatccttcccgcta

SEQ ID NO: 555420 - DNA, 478 bp, Homo sapiens
  misc_feature: HIJSMM301BHPOP.10.74.G08.1.454.light.4.raw
catagtagtgcacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaggagccaccctctcctgcagggccagtcagagtattagcagcaacttagcctggtaccagcagaaacctggccagtctcccaggctcctcctctatgatgcatccaccagggccactggtatcccagccaggttcagtggcagtgggtctgggacagagttcactctcaccatcagcagcctgcagtctgaggatattgctagtttattactgtcagcagtatactaactggcctctgacgttcggccaagggaccagggtgaatcaaacgaactgtggctgcaccat

SEQ ID NO: 555421 - DNA, 508 bp, Homo sapiens; identical to SEQ ID NO: 543419
  misc_feature: HIJSMM301CBBFV.4.10.A10.1.454.light.4.raw

SEQ ID NO: 555422 - DNA, 504 bp, Homo sapiens; identical to SEQ ID NO: 539083
  misc_feature: HIJSMM301BF7TB.8.19.B08.1.454.light.4.raw

SEQ ID NO: 555423 - DNA, 501 bp, Homo sapiens
  misc_feature: HIJSMM301AVONV.48.72.G06.1.454.light.4.raw
agtatacatacacgaccggtgctcgatttagctacgactgcaagggaaagggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcctcgggcgttcggccaagggaccgaacggtggaaagtacaaacgaactacgtggcgtgca

SEQ ID NO: 555424 - DNA, 489 bp, Homo sapiens
  misc_feature: HIJSMM301AZZDK.51.79.H02.1.454.light.4.raw
cgatcgtatacacgaccggtgctcgatttagtgtcacacgaagggaaagggcagctcctggggctgctaatgctctgggtcccaggatgcactggggatgttgtggtgactcagtctcctctctccctgcccgtcacccttggacaggcggcctccatctcctgcaggtctagtcacagcctcctacacagtgatggaaacacctacttgacttggtttcagcagaggcctggccaatctccaaggcgccttatttataaggtttctaatcgggtactttggggtcccagacagattcagcggcagtgggtcacgcactcacttcacactgaaaatcagcagggtggaggctgaggatttaggggtttattactgcatgcaaggtacacactggcctccgtacacttttggccaggggaccaagctcgagatcaaacgaactgtggctgcaccatctgtcttcatcttccgccatctgatcgtagcact

SEQ ID NO: 555425 - DNA, 502 bp, Homo sapiens
  misc_feature: HIJSMM301E03OV.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaagtggatatcaaacgaactagtggctgcaccatct

SEQ ID NO: 555426 - DNA, 494 bp, Homo sapiens; identical to SEQ ID NO: 534994
  misc_feature: HIJSMM301CQDMJ.27.78.H01.1.454.light.4.raw

SEQ ID NO: 555427 - DNA, 478 bp, Homo sapiens; identical to SEQ ID NO: 544059
  misc_feature: HIJSMM301AIBGA.40.59.F04.1.454.light.4.raw

SEQ ID NO: 555428 - DNA, 503 bp, Homo sapiens
  misc_feature: HIJSMM301A6JNY.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaacggccaacccccta

SEQ ID NO: 555429 - DNA, 505 bp, Homo sapiens
  misc_feature: HIJSMM301CG38M.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataatttctgggtgttcggcggagggaccaaactgaccgtcctaggtcagcccaaggctgccccctcggtcactctgtt

SEQ ID NO: 555430 - DNA, 502 bp, Homo sapiens
  misc_feature: HIJSMM301BWQNZ.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcacccatcaatagcctggaagctgaagatgctgcaacttattactgtcatcagatactactttacctcaagtgatcacttcggccaagggacacgactggagattaaacg

SEQ ID NO: 555431 - DNA, 460 bp, Homo sapiens
  misc_feature: HIJSMM301CRLGG.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttgggtgttcggcggagggaccaggctgaccgtcctaggtcagcccaaggccaaccccactgtcactctgttcccgccctcctcacgcgtatgt

SEQ ID NO: 555432 - DNA, 496 bp, Homo sapiens
  misc_feature: HIJSMM301DLDGS.12.38.D05.1.454.light.4.raw
atacgacgtacacgaccggtgctcgatttagtatctgatagttgggtttgggggaactgctcagttaggacccagacggaaccatggaagccccagcgcagcttctcttcctcctgctactctggctcccagattcctctggagaagttgtgatgacgcagtctccagccaccctgtctgcgtctccaggggaaagagtcaccctctcatgcagggccagtgagattgttaccaccaacttagcctggtaccaacagaaacctggccagcctcccaggctcctcatttatggtgcatccacaagggccgctggtgtcccagccaggttcagtggcagtggatctgcgacagagttcactctcaccgtcagcagcctgcagtctgaagattttgcagtttattactgtcagcagtatgagaagtggttcaagacttttcggcggagggaccaaggtggaggatcaaacgaactgtggctgcaccatctgtcttcatt

SEQ ID NO: 555433 - DNA, 481 bp, Homo sapiens; identical to SEQ ID NO: 539712
  misc_feature: HIJSMM301AUOAR.51.60.F05.1.454.light.4.raw

SEQ ID NO: 555434 - DNA, 481 bp, Homo sapiens
  misc_feature: HIJSMM301AN0BG.40.83.H06.1.454.light.4.raw
tctagcgactcacgaccggtgctcgatttagatcacgtgcgtcgcgggggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccttcacttgccgggcaagtcaggacattaaaagtgatttgggctggtatcagcagaaaccagggagagcccctaagctcctcatctatgctgcatccactttacaaagtggagtcccatcaaggttcagcggcagtggatctggcacagatttcactctcaccatcagcagcctgcagcctgaagattttgcaacttattattgtctacacgactacagttaccctcggacgttcggccaagggaccgaaggtaggaatcaaacgaactagtggcgtgcacc

SEQ ID NO: 555435 - DNA, 507 bp, Homo sapiens; identical to SEQ ID NO: 550515
  misc_feature: HIJSMM301BQL2A.12.73.G07.1.454.light.4.raw

SEQ ID NO: 555436 - DNA, 521 bp, Homo sapiens
  misc_feature: HIJSMM301A1CHW.41.25.C03.1.454.light.4.raw
tctatactatcacgaccggtgctcgatttagtagtgtagatttgggtttgggggtgatagctcaggaagcagagcctggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctggggtcccctttcggttttctggctccatcgacagtccctccaactccgcctcccttaccatatctgggctgaagagtgaggacgaggctgactacttctgtcagtcttatgatataaacaattatgtgataattggcggagggaccagggtgaccgtcctaggtcagcccaaggctgccccctcggtcactctgttccccg

SEQ ID NO: 555437 - DNA, 446 bp, Homo sapiens
  misc_feature: HIJSMM301AN1TA.7.18.B07.1.454.light.4.raw
cgtgtctctacacgaccggtgctcgatttagtcgctgcgtaagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctcgttccccaccctcctctagagacacg

SEQ ID NO: 555438 - DNA, 489 bp, Homo sapiens; identical to SEQ ID NO: 536013
  misc_feature: HIJSMM301B5XB2.26.23.C01.1.454.light.4.raw

SEQ ID NO: 555439 - DNA, 520 bp, Homo sapiens
  misc_feature: HIJSMM301B7LOG.27.23.C01.1.454.light.4.raw
  modified_base (517)..(517): a, c, t, g, unknown or other
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggtccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccncct

SEQ ID NO: 555440 - DNA, 452 bp, Homo sapiens; identical to SEQ ID NO: 539381
  misc_feature: HIJSMM301E0K1S.13.23.C01.1.454.light.4.raw

SEQ ID NO: 555441 - DNA, 490 bp, Homo sapiens
  misc_feature: HIJSMM301EYRWJ.26.37.D04.1.454.light.4.raw
agactatactcacgaccggtgctcgatttagtagcatactgttgggtttgggggaggaactgctcagttaggacccacgccggaaccatggaagccccacgcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagcctggtaccagcagacacctgggcagactcccaggctcctcatttatgctgcatccaccagggccactggtatcccagccaggttcagtggcagtgggtctgggacagagttcactctcaccatcagcagcctgcagtctgaagattgtgcaatttattactgtcagcaatataatacctggcctccgctcactttcggcggagggaccaaggttgagatcaaacgaactgtggctgcacca

SEQ ID NO: 555442 - DNA, 495 bp, Homo sapiens
  misc_feature: HIJSMM301A2VGD.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggccaagggaccagggtggaaatacaacgaaactgtggctgcaccatctgtcttcat

SEQ ID NO: 555443 - DNA, 485 bp, Homo sapiens; identical to SEQ ID NO: 538533
  misc_feature: HIJSMM301BLALJ.47.78.H01.1.454.light.4.raw

SEQ ID NO: 555444 - DNA, 475 bp, Homo sapiens
  misc_feature: HIJSMM301E2ZBO.15.81.H04.1.454.light.4.raw
tctacgtagccacgaccggtgctcgatttagtagtgtagattcgcggggggggtcgtcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgcatctcatatacaaccaacagcactctcgactggtattcggcggagggaccaagctgaccgtcctaggtcagcccaaggctgccccctcggtcactctgttcccaccctcctcgctacgtaga

SEQ ID NO: 555445 - DNA, 493 bp, Homo sapiens; identical to SEQ ID NO: 542565
  misc_feature: HIJSMM301A1EDI.48.71.G05.1.454.light.4.raw

SEQ ID NO: 555446 - DNA, 506 bp, Homo sapiens
  misc_feature: HIJSMM301CZ4T5.47.55.E11.1.454.light.4.raw
agctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctaggtcagcccaaggccaaccc

SEQ ID NO: 555447 - DNA, 505 bp, Homo sapiens
  misc_feature: HIJSMM301AP3HN.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaaattgagatcaaacgaactgtggctgcaccatctgtcttctatcttcccgcc

SEQ ID NO: 555448 - DNA, 444 bp, Homo sapiens; identical to SEQ ID NO: 536096
  misc_feature: HIJSMM301D6S7U.7.18.B07.1.454.light.4.raw

SEQ ID NO: 555449 - DNA, 503 bp, Homo sapiens; identical to SEQ ID NO: 536834
  misc_feature: HIJSMM301BBGQU.2.35.D02.1.454.light.4.raw

SEQ ID NO: 555450 - DNA, 495 bp, Homo sapiens; identical to SEQ ID NO: 539267
  misc_feature: HIJSMM301B33EV.21.27.C05.1.454.light.4.raw

SEQ ID NO: 555451 - DNA, 516 bp, Homo sapiens; identical to SEQ ID NO: 536108
  misc_feature: HIJSMM301C4UCW.22.30.C08.1.454.light.4.raw

SEQ ID NO: 555452 - DNA, 515 bp, Homo sapiens; identical to SEQ ID NO: 549865
  misc_feature: HIJSMM301BL71U.16.66.F11.1.454.light.4.raw

SEQ ID NO: 555453 - DNA, 521 bp, Homo sapiens; identical to SEQ ID NO: 539470
  misc_feature: HIJSMM301BYJ4K.27.23.C01.1.454.light.4.raw

SEQ ID NO: 555454 - DNA, 454 bp, Homo sapiens; identical to SEQ ID NO: 535005
  misc_feature: HIJSMM301DEM4C.19.86.H09.1.454.light.4.raw

SEQ ID NO: 555455 - DNA, 354 bp, Homo sapiens; identical to SEQ ID NO: 535026
  misc_feature: HIJSMM301DMFDL.19.22.B11.1.454.light.4.raw

SEQ ID NO: 555456 - DNA, 494 bp, Homo sapiens
  misc_feature: HIJSMM301AQ9ZV.5.48.E04.1.454.light.4.raw
atcagacacgcacgaccggtgctcgatttagagagcgtcacagagagaaggggaggacccagagggaaccatggaaaccccagcgcagcttctcttcctcctgctactctggctcccagattctgccggagaagttgtcttgacgcagtctccaggcaccctgtctttgtctccaggtgaaagcgccaccctctcctgccgggccagtgagagtcttagcggcgactacttagcctggtatcagcaaaaacctggccagtctcccaggctcctcatctctggtgtttccttcagggccactggcgtcccaggcagattcgaggggcagtgggtctgggacagacttcactctcaccatcagcagactggagcctgaagactttgcgctgtatttctgtcagcagtatgttttcgcacctttcacttttcggcggagggaccaaggtggagagcagacgaactgtggctgcaccatctgtcttcatcttcccgcc

SEQ ID NO: 555457 - DNA, 492 bp, Homo sapiens
  misc_feature: HIJSMM301BQKIR.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtgagatcaaacgaactgtggctgcaccatctgtcttcatccttcccgccat

SEQ ID NO: 555458 - DNA, 483 bp, Homo sapiens
  misc_feature: HIJSMM301CV1KL.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggtttttggctgttcggcggcgggaccg

SEQ ID NO: 555459 - DNA, 493 bp, Homo sapiens
  misc_feature: HIJSMM301CJA4X.11.81.H04.1.454.light.4.raw
cgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtatgggacagagttcactctcaccatcagcagcctgcagtctgaagattttgcagttttttactgtcagcagtatagtaactggcctccgtacacttttggccaggggaccaagctagaaatcaaacgaactgtggctgcaccatctgtcttc

SEQ ID NO: 555460 - DNA, 503 bp, Homo sapiens
  misc_feature: HIJSMM301AKIUO.8.42.D09.1.454.light.4.raw
ctcgcgtgtccacgaccggtgctcgatttagacacatacgcagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcggcggagggaccaagttgaccgtcctaggtcagcccaaggctgccccctcggtcactctgtt

SEQ ID NO: 555461 - DNA, 493 bp, Homo sapiens; identical to SEQ ID NO: 539456
  misc_feature: HIJSMM301DDP5Q.10.79.H02.1.454.light.4.raw

SEQ ID NO: 555462 - DNA, 520 bp, Homo sapiens; identical to SEQ ID NO: 539176
  misc_feature: HIJSMM301CHCPI.27.23.C01.1.454.light.4.raw

SEQ ID NO: 555463 - DNA, 503 bp, Homo sapiens
  misc_feature: HIJSMM301BRPLN.43.14.B03.1.454.light.4.raw
tgtgagtagtcacgaccggtgctcgatttagtgtgagtagttccgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcacttatgtcttcggaactgggaccaaggtcaccgacctaggtcagcccaaggccaaccccactgtca

SEQ ID NO: 555464 - DNA, 508 bp, Homo sapiens
  misc_feature: HIJSMM301BA1Q8.47.85.H08.1.454.light.4.raw
agctcacgtacacgaccggtgctcgatttagtatcactcagtcgcgggggctggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaaggttgaccgtcctaggtcagcccaaggctgccccctcggtcact

SEQ ID NO: 555465 - DNA, 489 bp, Homo sapiens; identical to SEQ ID NO: 535139
  misc_feature: HIJSMM301BHMLO.14.55.E11.1.454.light.4.raw

SEQ ID NO: 555466 - DNA, 499 bp, Homo sapiens
  misc_feature: HIJSMM301CCG1F.43.35.D02.1.454.light.4.raw
tgtgagtagtcacgaccggtgctcgatttagcacacgatagttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaaccca

SEQ ID NO: 555467 - DNA, 481 bp, Homo sapiens
  misc_feature: HIJSMM301CQISU.13.48.E04.1.454.light.4.raw
tcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtggggtcccatcaaggttcagcggcagtggatctggcacagacttcattctcaccatcagcagcctgcagcctgaagattttgcaacttattactgtctacaagatcacaattatcctgggacgttcgcaacgggacaacggtggaaagtacaaacgaactagtgg

SEQ ID NO: 555468 - DNA, 441 bp, Homo sapiens; identical to SEQ ID NO: 535074
  misc_feature: HIJSMM301BJPOR.11.3.A03.1.454.light.4.raw

SEQ ID NO: 555469 - DNA, 494 bp, Homo sapiens; identical to SEQ ID NO: 534992
  misc_feature: HIJSMM301DN7JU.9.1.A01.1.454.light.4.raw

SEQ ID NO: 555470 - DNA, 505 bp, Homo sapiens
  misc_feature: HIJSMM301DZ6IH.40.60.F05.1.454.light.4.raw
tctagcgactcacgaccggtgctcgatttagtacgtcatcagggaaagggggagctgctcagttaggacccagagggaaccatggaaaccccagcgcagcttctcttcctcctgctactctggctcccagagacccccggagaaattgtgttgacgcagtctccaggcaccctgtctttgtctccaggggaaagagccaccctctcctgcagggccagtcagagtgtaaccaacaactacttaatgtggtaccagcaaaaacctggccaggctcccaggctcctcatctatggtgcatccaacagggccagtggcatcccagacaggtttagaggcagtggggccgacacagacttcactctcaccatcagcagactggagcctgaagattttgcactgtattactgtcaccagcgtagcagctggcctcgaacgttcggccaagggacaacggtggacatcaagcgaactgtggctgcaccatctgtcttcatcttcccgccta

SEQ ID NO: 555471 - DNA, 502 bp, Homo sapiens; identical to SEQ ID NO: 537816
  misc_feature: HIJSMM301A9ZXC.19.78.H01.1.454.light.4.raw

SEQ ID NO: 555472 - DNA, 509 bp, Homo sapiens
  misc_feature: HIJSMM301AWU16.5.60.F05.1.454.light.4.raw
atcagacacgcacgaccggtgctcgatttagtacgtcatcagggaaagggtagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctggaagcacctccaacatcggaagtaatattgtaaactggtaccagcagctcccaggaacggcccccaaactcctcatctataggaataatcaacggccctcaggggtccctgaccgattctctggctccaagtctggcacctcagcctccctggccatccgtgggctccagtctgaggatgagtctgattattactgtgcaacatgggatgacagcctgaatggtccggtattcggcggagggaccaagctgaccgtcctcggtcagcccaaggctgccccctcc

SEQ ID NO: 555473 - DNA, 454 bp, Homo sapiens; identical to SEQ ID NO: 534964
  misc_feature: HIJSMM301D5ZLC.19.86.H09.1.454.light.4.raw

SEQ ID NO: 555474 - DNA, 479 bp, Homo sapiens; identical to SEQ ID NO: 535665
  misc_feature: HIJSMM301CRNYR.12.10.A10.1.454.light.4.raw

SEQ ID NO: 555475 - DNA, 490 bp, Homo sapiens
  misc_feature: HIJSMM301C29WJ.48.65.F10.1.454.light.4.raw
agtatacatacacgaccggtgctcgatttagctacgctctaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggagttataaccttgtctcctggtaccaacagcacccaggcaaagcccccaaactcatgatttatgaggacagtaagcggccctcaggggtttctaatcgcttctctggctccaagtctggcaacacggcctccctgacaatctctgggctccaggctgaggacgaggctgattattactgctgctcatatgcagatagtagcactcatgtggtattcggcggagggaccaagctgaccgtcctaggtcagcccaaggctcg

SEQ ID NO: 555476 - DNA, 513 bp, Homo sapiens
  misc_feature: HIJSMM301AH5WC.48.80.H03.1.454.light.4.raw
agtatacatacacgaccggtgctcgatttagctgtgcgtcgaagggaaaggggagtctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatccggtcttcggcggagggaccaagttgaccttcctaagtcagcccaaggctgccccctcggtcactctgttcccg

SEQ ID NO: 555477 - DNA, 494 bp, Homo sapiens
  misc_feature: HIJSMM301CEP2D.9.50.E06.1.454.light.4.raw
tgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccgaacggaccgaaagtggacatacaagacgaactagtggcgtgcaccact

SEQ ID NO: 555478 - DNA, 501 bp, Homo sapiens
  misc_feature: HIJSMM301D4NRO.11.31.C09.1.454.light.4.raw
  modified_base (482)..(482): a, c, t, g, unknown or other
cgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagattattttatacagctccgacagtaagaactacttatcttggttccaacagaaaccaggacagcctcctaaattactcatttattccacatctatgcgggcctccggggtccccgaccgattcagtggcagcgggtctgggacagatttcactctcacaatcagcagcctgcagactgaagatgtgggcgtttattattgtcaacaatattctcttgttccgtttaatttcggcggagggaccaaggtggagatcaaacgaactgtggctgcaccatcngtcttcatcttcccgccat

SEQ ID NO: 555479 - DNA, 494 bp, Homo sapiens; identical to SEQ ID NO: 535629
  misc_feature: HIJSMM301BQGET.4.27.C05.1.454.light.4.raw

SEQ ID NO: 555480 - DNA, 508 bp, Homo sapiens
  misc_feature: HIJSMM301EBA1I.19.67.G01.1.454.light.4.raw
tactctcgtgcacgaccggtgctcgatttagagtatacatattgggtttgggacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttctccacctccaagaacaaaaacttcttagcctggtaccaacagagaccaggacagcctcctaagttgctcatttactgggcttctacgcgcgaattcggggtccctgaccgattccggggacagcgggtctgggacagatttcactctcaccatcagcagcctgcaggctgaagatgtggcagtttattactgtcagcaatatttttcttatcctccgtggaccgttcggccaagggaccagggtggaaaatcagacgaactgtggctgcaccatctgtctt

SEQ ID NO: 555481 - DNA, 484 bp, Homo sapiens; identical to SEQ ID NO: 540489
  misc_feature: HIJSMM301BOHFD.7.75.G09.1.454.light.4.raw

SEQ ID NO: 555482 - DNA, 501 bp, Homo sapiens; identical to SEQ ID NO: 536142
  misc_feature: HIJSMM301BJL5X.15.1.A01.1.454.light.4.raw

SEQ ID NO: 555483 - DNA, 499 bp, Homo sapiens; identical to SEQ ID NO: 536578
  misc_feature: HIJSMM301EXKKV.22.27.C05.1.454.light.4.raw

SEQ ID NO: 555484 - DNA, 495 bp, Homo sapiens; identical to SEQ ID NO: 538269
  misc_feature: HIJSMM301C1G5N.9.1.A01.1.454.light.4.raw

SEQ ID NO: 555485 - DNA, 493 bp, Homo sapiens
  misc_feature: HIJSMM301CZD44.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcgccacgggaccgacggtcggagtgtcgagacgaactagtgtcgtgcaccactcttcg

SEQ ID NO: 555486 - DNA, 491 bp, Homo sapiens; identical to SEQ ID NO: 535194
  misc_feature: HIJSMM301AK27E.26.78.H01.1.454.light.4.raw

SEQ ID NO: 555487 - DNA, 486 bp, Homo sapiens; identical to SEQ ID NO: 535043
  misc_feature: HIJSMM301BXND8.46.35.D02.1.454.light.4.raw

SEQ ID NO: 555488 - DNA, 515 bp, Homo sapiens
  misc_feature: HIJSMM301DI5OS.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaacggcccccaaactcctcatctataggaataatcagcggccctcaggggtccctgaccgattctctggctccaaggctggcacctcagcctccctggccatcagtgggctccgatccgaggatgaggctgattattactgtgtagcatgggatgacagcctgagtggtccttgggtgttcggcggagggaccaagctgaccgtcctaagtcagcccaaggctgccccctcggtcactctgttcccaccctcctcg

SEQ ID NO: 555489 - DNA, 506 bp, Homo sapiens
  misc_feature: HIJSMM301ERUA6.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaaattgagatcaaacgaactgtggctgcaccatctgtcttcgtcttcccgccat

SEQ ID NO: 555490 - DNA, 497 bp, Homo sapiens
  misc_feature: HIJSMM301EUTB5.40.35.D02.1.454.light.4.raw
tctagcgactcacgaccggtgctcgatttagcacacgatagttgggtttgggggggtcgtcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttattttgtctgctcttatgcaggcagtttcgctctcgaagtgttcggcggaggaccgagctgaccgtcctacgtcagcccaaggctcg

SEQ ID NO: 555491 - DNA, 490 bp, Homo sapiens; identical to SEQ ID NO: 536909
  misc_feature: HIJSMM301AV1MP.12.27.C05.1.454.light.4.raw

SEQ ID NO: 555492 - DNA, 489 bp, Homo sapiens
  misc_feature: HIJSMM301BHMLL.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctggacgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggtccaagggaccaaggtaggagtatcagacgaa

SEQ ID NO: 555493 - DNA, 482 bp, Homo sapiens; identical to SEQ ID NO: 535796
  misc_feature: HIJSMM301D7HGT.51.64.F09.1.454.light.4.raw

SEQ ID NO: 555494 - DNA, 493 bp, Homo sapiens; identical to SEQ ID NO: 536246
  misc_feature: HIJSMM301D4TYE.49.66.F11.1.454.light.4.raw

SEQ ID NO: 555495 - DNA, 521 bp, Homo sapiens; identical to SEQ ID NO: 536990
  misc_feature: HIJSMM301EDNO7.27.23.C01.1.454.light.4.raw
  modified_base (517)..(517): a, c, t, g, unknown or other

SEQ ID NO: 555496 - DNA, 505 bp, Homo sapiens
  misc_feature: HIJSMM301AFOJG.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcgccaagggaccaaggtggaatactaaacgaactagtggcgtgcaccatctgtcttctatcttccccg

SEQ ID NO: 555497 - DNA, 512 bp, Homo sapiens
  misc_feature: HIJSMM301C62RS.48.59.F04.1.454.light.4.raw
agtatacatacacgaccggtgctcgatttagtacacacacttagggattggggagagaagacaggactcaggacaatctccagcatggccagcttccctctcctcctcaccctcctcactcactgtgcagggtcctgggcccagtctgtgctgactcagccaccctcagcgtctgggacccccggtcagagtgtcaccatctcttgttctggaagcggctccaacatcggaagaaatactgtgaactggtaccagcagctcccaggagcggcccccagactctacatctataataattatcgccggccctcaggggtccctgaccgagtctctgcctccaagtctggcacctcagcctccctggccatcagtggcctccggtctgaagaggagggtgattattactgtgcagcgtgggatgacagcctgaatgcttgggtgttcggcggaggggaccaagttgaccgtcctaggtcaacccaaggctgccccctcggtcactctgttcccta

SEQ ID NO: 555498 - DNA, 514 bp, Homo sapiens
  misc_feature: HIJSMM301ELRCW.12.53.E09.1.454.light.4.raw
atacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgtatgtcctattcggcggagggaccgaagctgaccgtcctgggtcgagcccaacggctgccccctccggtccacctctgttcccacccctcctcctacgtcgtat

SEQ ID NO: 555499 - DNA, 494 bp, Homo sapiens; identical to SEQ ID NO: 537805
  misc_feature: HIJSMM301C892P.51.6.A06.1.454.light.4.raw

SEQ ID NO: 555500 - DNA, 493 bp, Homo sapiens; identical to SEQ ID NO: 536769
  misc_feature: HIJSMM301BZDCN.19.83.H06.1.454.light.4.raw

SEQ ID NO: 555501 - DNA, 481 bp, Homo sapiens
  misc_feature: HIJSMM301CKX8O.7.76.G10.1.454.light.4.raw
cgtgtctctacacgaccggtgctcgatttagtcactcatacagggggcaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagcccctaaactcctgatctctgctgcatccagtttacaaagtggggtcccatcgcggttcagcggcagtggatatgggacatatttcactctcccgcatcagcagcctgcagcctgaagattttgcaacttactattgtcaacaggctaacagtttcccgctcaccttcggcgggggaccaaggtggaggatcaaacgaactagtggctgcacc

SEQ ID NO: 555502 - DNA, 497 bp, Homo sapiens; identical to SEQ ID NO: 535664
  misc_feature: HIJSMM301DL4YD.22.14.B03.1.454.light.4.raw

SEQ ID NO: 555503 - DNA, 501 bp, Homo sapiens
  misc_feature: HIJSMM301ADGA4.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggtccaagggaccgagggtggaaagtacaaacgaactagtggcgtgcaccatctgtcttcatt

SEQ ID NO: 555504 - DNA, 495 bp, Homo sapiens
  misc_feature: HIJSMM301BX9SI.51.23.C01.1.454.light.4.raw
cgatcgtatacacgaccggtgctcgatttagtacacgtgattagggattgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgtcact

SEQ ID NO: 555505 - DNA, 510 bp, Homo sapiens; identical to SEQ ID NO: 535855
  misc_feature: HIJSMM301A4EO2.17.33.C11.1.454.light.4.raw

SEQ ID NO: 555506 - DNA, 510 bp, Homo sapiens
  misc_feature: HIJSMM301AT2HT.51.35.D02.1.454.light.4.raw
cgatcgtatacacgaccggtgctcgatttagcacacgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaagcccccaaactcatgatttatgatgtcagtgatcggccctcaggggtttcgaatcgcttctctggctccaagtccggcaacacggcctccctgaccatctctggcctccaggccgaggacgaggctgattattactgcagctcatatacaatcaaataacaattgggtgttcggcggagggaccaaactgaccgtcctaggtcagcccaaggctgccccctcggtca

SEQ ID NO: 555507 - DNA, 455 bp, Homo sapiens; identical to SEQ ID NO: 535447
  misc_feature: HIJSMM301AP7Q2.19.71.G05.1.454.light.4.raw

SEQ ID NO: 555508 - DNA, 492 bp, Homo sapiens
  misc_feature: HIJSMM301EYNJD.43.60.F05.1.454.light.4.raw
tgtgagtagtcacgaccggtgctcgatttagtacgtcatcagggaaagggggcaggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcggtccagggaccgacggtcggagtagtctaagcgaactagtggcgtgcacca

SEQ ID NO: 555509 - DNA, 485 bp, Homo sapiens; identical to SEQ ID NO: 535688
  misc_feature: HIJSMM301A3G6I.19.5.A05.1.454.light.4.raw

SEQ ID NO: 555510 - DNA, 522 bp, Homo sapiens
  misc_feature: HIJSMM301AVVE3.5.27.C05.1.454.light.4.raw
atcagacacgcacgaccggtgctcgatttagacgcgatcgaagggtttgggggtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccacctgtcactctgttcccaccctcctccgtgt

SEQ ID NO: 555511 - DNA, 518 bp, Homo sapiens
  misc_feature: HIJSMM301BXEKP.22.30.C08.1.454.light.4.raw
acatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaaggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggctgccccctcggtcactctgttcccaccctcctcacgcg

SEQ ID NO: 555512 - DNA, 508 bp, Homo sapiens; identical to SEQ ID NO: 537871
  misc_feature: HIJSMM301ECRZI.8.33.C11.1.454.light.4.raw

SEQ ID NO: 555513 - DNA, 494 bp, Homo sapiens; identical to SEQ ID NO: 539784
  misc_feature: HIJSMM301A3OME.22.57.F02.1.454.light.4.raw

SEQ ID NO: 555514 - DNA, 508 bp, Homo sapiens; identical to SEQ ID NO: 540640
  misc_feature: HIJSMM301CESQL.5.60.F05.1.454.light.4.raw

SEQ ID NO: 555515 - DNA, 494 bp, Homo sapiens; identical to SEQ ID NO: 541183
  misc_feature: HIJSMM301BVA70.19.71.G05.1.454.light.4.raw

SEQ ID NO: 555516 - DNA, 496 bp, Homo sapiens; identical to SEQ ID NO: 544216
  misc_feature: HIJSMM301AW495.18.11.A11.1.454.light.4.raw

SEQ ID NO: 555517 - DNA, 493 bp, Homo sapiens
  misc_feature: HIJSMM301DFP8T.4.27.C05.1.454.light.4.raw
agcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggccctcagggatccctgagcgcttctctggatccaactctgggaacacagccactctgaccatcagcgggacccaacttttagatgaggccgactatttctgtcacacgtgggacatgggcactgcgatcttcggcggaggaccaagctgaccgtcctgggtcagcccaaggctgcccctcggtcactc

SEQ ID NO: 555518 - DNA, 490 bp, Homo sapiens; identical to SEQ ID NO: 538273
  misc_feature: HIJSMM301C8UNL.16.73.G07.1.454.light.4.raw

SEQ ID NO: 555519 - DNA, 489 bp, Homo sapiens; identical to SEQ ID NO: 544329
  misc_feature: HIJSMM301BX460.11.28.C06.1.454.light.4.raw

SEQ ID NO: 555520 - DNA, 345 bp, Homo sapiens
  misc_feature: HIJSMM301EYQD2.21.87.H10.1.454.light.4.raw
tcgtcgctcgcacgaccggtgctcgatttagcagtactgcgttgggttttaaccttgtctcctggtatcaacaacaccaggacaaagccccaaaactcttaatttctggcgtcaatcagcgaccctcacatgtttccagtcgattctctgcatccaagtctggcaacacggcctttctgacaatctctcaactccaggctgaagacgaggctatttattactgctcctcatacgcaggtggcacattttttcttggtttttggcggcgggacccagatgactgtcctcagtcagcccaaggctgccccctcggtcactctgttcccaccctcctccgagcgacga

SEQ ID NO: 555521 - DNA, 487 bp, Homo sapiens; identical to SEQ ID NO: 537220
  misc_feature: HIJSMM301C769Q.16.53.E09.1.454.light.4.raw

SEQ ID NO: 555522 - DNA, 479 bp, Homo sapiens
  misc_feature: HIJSMM301AENED.5.28.C06.1.454.light.4.raw
atcagacacgcacgaccggtgctcgatttagagctcacgtattgggtttgggggcaggagtcagtcccaaccaggacacagcatggacatgagggtccctgctcagctcctggggctcctgctgctctggctctcaggtgccagatgtgacatccagatgacccagtctccatcgtccgtgtctgcatctgtaggagacagagtcaccatcacttgtcaggcgagtcaggacattggtaattacttaacttggtatcagcagaaaccagggaaagtccccaaactcctgatctacgatgcatctaatttggaaataggggtctcatcaaggttcagtgggagtggatctgggacagaattcactttcaccatcagcagcctgcaacctgaagatattgcaacatattactgtcaacagtatgatagtctggccgccttcggtcggagggaccgaaggtggagatcgaacgaactagtgg

SEQ ID NO: 555523 - DNA, 444 bp, Homo sapiens; identical to SEQ ID NO: 534993
  misc_feature: HIJSMM301EMVT7.5.9.A09.1.454.light.4.raw

SEQ ID NO: 555524 - DNA, 494 bp, Homo sapiens
  misc_feature: HIJSMM301D6KZK.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctatctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatctgtcttcatcttccccg

SEQ ID NO: 555525 - DNA, 498 bp, Homo sapiens
  misc_feature: HIJSMM301CT3VO.18.59.F04.1.454.light.4.raw
tacgagtatgcacgaccggtgctcgatttagtacacacacttagggattggggggggtctcaggaggcagcgctctcgggacttctccaccatggcctgggctctgctattcctcaccctcctcactcagggcacagggtcctgggcccagtctgccctgactcagcctgcctccatgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaa

SEQ ID NO: 555526 - DNA, 515 bp, Homo sapiens
  misc_feature: HIJSMM301BCCSS.43.23.C01.1.454.light.4.raw
tgtgagtagtcacgaccggtgctcgatttagtacacgtgattagggattggggctggcgccaggggtcccttccaatatcagcaccatggcctggactcctctctttctgttcctcctcacttgctgcccagggtccaattctcagactgtggtgagggaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcgggggcaaagctgccctgacactgtcaggtgtgcagcctgaggacgaggctgactattactgcctgctcatatatggtggcgcgtgggtgttcggcggagggaccaagctgaccgtcctgggtcagcccaaggctgccccctggtcactctgttcccaccctcct

SEQ ID NO: 555527 - DNA, 496 bp, Homo sapiens
  misc_feature: HIJSMM301B2MIS.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtccccctcgaggttcagtggcagtggatctgggacacatttcaccctcaccatcaatagcctggaagctgaagatgctgcaacttattactgtcatcaagagtactactttacctcaagtgatcaccttcggccaagggacacgactggagattaaacgaactgtggctgcaccatctgtctt

SEQ ID NO: 555528 - DNA, 491 bp, Homo sapiens
  misc_feature: HIJSMM301CJ10K.43.33.C11.1.454.light.4.raw
tgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcaccctttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctcccccctacaatttcggtcaggggaccaagttgaacatcaatcgaactgtggctgcaccatctgtctt

SEQ ID NO: 555529 - DNA, 515 bp, Homo sapiens
  misc_feature: HIJSMM301AWCM7.43.59.F04.1.454.light.4.raw
tgtgagtagtcacgaccggtgctcgatttagtacacacacttagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaagcccccaaactcttgatttatgatgtcacttatcggccctcaggggtttcttatcgcttctctggctccaagtctggcaacacggcctccctgaccatctctgggctccaggctgaggacgaggctgattattactgcaactcacttacaacgaccgacacttgcgtattcggcggcgggaccaagctgaccgtcctaggtcagcccaaggctgccccctcggtcacctctgtt

SEQ ID NO: 555530 - DNA, 513 bp, Homo sapiens
  misc_feature: HIJSMM301DPPFQ.13.53.E09.1.454.light.4.raw
tcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaaacagattttaccctcaccatcaggggtctacagcctgaagattttgcgacttactattgtcaacagagttaccttctcccccggacgtcgcgtacggaccgaacggtaggaagtacaacgacgaacgtagtcggtctggcaccactctcgtcttctactt

SEQ ID NO: 555531 - DNA, 487 bp, Homo sapiens; identical to SEQ ID NO: 536536
  misc_feature: HIJSMM301A79RQ.26.45.E01.1.454.light.4.raw

SEQ ID NO: 555532 - DNA, 478 bp, Homo sapiens; identical to SEQ ID NO: 539087
  misc_feature: HIJSMM301EU68S.48.5.A05.1.454.light.4.raw

SEQ ID NO: 555533 - DNA, 484 bp, Homo sapiens; identical to SEQ ID NO: 535400
  misc_feature: HIJSMM301BA0V4.46.26.C04.1.454.light.4.raw

SEQ ID NO: 555534 - DNA, 493 bp, Homo sapiens; identical to SEQ ID NO: 536032
  misc_feature: HIJSMM301BMYFX.22.57.F02.1.454.light.4.raw

SEQ ID NO: 555535 - DNA, 521 bp, Homo sapiens; identical to SEQ ID NO: 538715
  misc_feature: HIJSMM301DHFTE.27.23.C01.1.454.light.4.raw

SEQ ID NO: 555536 - DNA, 521 bp, Homo sapiens
  misc_feature: HIJSMM301B468E.12.71.G05.1.454.light.4.raw
atacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaatttttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaaagtgaccgtcctaagtcagcccaaggctgccccctcggtcactctgttcccaccct

SEQ ID NO: 555537 - DNA, 483 bp, Homo sapiens
  misc_feature: HIJSMM301DJIQA.49.20.B09.1.454.light.4.raw
agtcgagagacacgaccggtgctcgatttagtgtagtgtgaagggagcaccgtggagaagacagtggcccctgcagaattttcataggttctcaacccttcacactacacaggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaacaatatgcttactggtaccagcagaggccaggccaggcccctgtcttggtgatttataaagactttgagaggccctcagggacccctgagcgattctctggctccagctcagggacaacagtcaccttgaccatcagtggagtccggccagaggacgaggctgactattactgtcagtccgcagacagc

SEQ ID NO: 555538 - DNA, 516 bp, Homo sapiens; identical to SEQ ID NO: 535549
  misc_feature: HIJSMM301B89EM.14.70.G04.1.454.light.4.raw

SEQ ID NO: 555539 - DNA, 447 bp, Homo sapiens; identical to SEQ ID NO: 535201
  misc_feature: HIJSMM301BIEJC.18.9.A09.1.454.light.4.raw

SEQ ID NO: 555540 - DNA, 488 bp, Homo sapiens
  misc_feature: HIJSMM301DE7M3.52.23.C01.1.454.light.4.raw
cgcagtacgacacgaccggtgctcgatttagtacacgtgattagggattgggggtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaactatttaaattggtatcagcagaaaccagggaaagcccctaaactcctgatctacgatgcatccaatttggagacaggggtcccatcaaggttcactggaagtggatctgggacacattttactttcaccatcagcggcctgcagcctgaagattttgcaacatattactgtcaacaatatgaagatctccccctcactttcggcggagggaccaaggtggagatcagacgaactgtggctgcacccatctgtt

SEQ ID NO: 555541 - DNA, 502 bp, Homo sapiens
  misc_feature: HIJSMM301CSTRQ.52.65.F10.1.454.light.4.raw
cgcagtacgacacgaccggtgctcgatttagctacgctctaagggggcaggagtcagacccagtcaggacacagcatggacatgagggtccccgctcagctcctggggctcctgctgctctggttcccaggtgccaggtgcgacatccagatgacccagtctccatcttccgtgtctgcatctgtaggagacagagtcaccatcacttgtcgggcgagtcaggttgttagcgcctggttagcctggtatcagcaaagaaaccagggaaagcccctaaagtcctggtctatgctacatccaatttgcaaagtggcgtcccctcaaggttccgcggcagtggatctgggacaaatttcactctcaccatcagcagcctgcagcctgaagattttgcgacttactattgtcaacaggggtacagttttccgtacacctttggccaggggactaagctggacatacaaacgaactgtggctgcaccatctgtcttcatcttccccg

SEQ ID NO: 555542 - DNA, 516 bp, Homo sapiens; identical to SEQ ID NO: 551269
  misc_feature: HIJSMM301C245C.47.53.E09.1.454.light.4.raw

SEQ ID NO: 555543 - DNA, 485 bp, Homo sapiens
  misc_feature: HIJSMM301DBIB1.17.55.E11.1.454.light.4.raw
cgtagactagcacgaccggtgctcgatttagcactcgcacgttgggtttggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacagtaagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcctctcactttcggcggagggaccaaggtggagatcaaacgaa

SEQ ID NO: 555544 - DNA, 493 bp, Homo sapiens
  misc_feature: HIJSMM301C5EG1.41.38.D05.1.454.light.4.raw
tctatactatcacgaccggtgctcgatttagtatctgatagttgggtttgggggagccagacccagtcaggacacagcatggacatgagggtccccgctcagctcctggggctcctgctgctctggttcccaggttccagatgcgacatccagatgacccagtctccatcttctgtgtctgcatctgtcggagacagagtcaccatcacttgtcgggcgagtcagggtattggcagctacttagtctggtatcaacaaaaaccagggaaagcccctaaactccttatttatggatcatccagtttacaaagtgggtcccatcaaggttcagcggcagtggatctgggacacatttcactctcactatcagcagcctgcagcctgaggattttgcgacttactattgtcaacaggctgacagtttccctctcactttcggcggagggccaaggttgagaccaaacgaactgtggctgcaccatctgtcttcatt

SEQ ID NO: 555545 - DNA, 468 bp, Homo sapiens
  misc_feature: HIJSMM301C078I.48.48.E04.1.454.light.4.raw
agtatacatacacgaccggtgctcgatttagagagcgtcacagagagaagggggaagagctgctcagttaggacccagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttccccgccatctgatatgtatact

SEQ ID NO: 555546 - DNA, 494 bp, Homo sapiens; identical to SEQ ID NO: 534992
  misc_feature: HIJSMM301DRK2U.9.1.A01.1.454.light.4.raw

SEQ ID NO: 555547 - DNA, 487 bp, Homo sapiens; identical to SEQ ID NO: 550356
  misc_feature: HIJSMM301AH7QN.4.57.F02.1.454.light.4.raw

SEQ ID NO: 555548 - DNA, 504 bp, Homo sapiens; identical to SEQ ID NO: 535561
  misc_feature: HIJSMM301DTVC5.4.57.F02.1.454.light.4.raw

SEQ ID NO: 555549 - DNA, 495 bp, Homo sapiens
  misc_feature: HIJSMM301CNV9O.40.57.F02.1.454.light.4.raw
tctagcgactcacgaccggtgctcgatttagctcgatatagttgggtttgggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttattttgctgctcttatgcaggcagtttcgctctcgaagtgttcggcggagggccgagctgaccgtcctacgtcagcccaaggctcg

SEQ ID NO: 555550 - DNA, 483 bp, Homo sapiens; identical to SEQ ID NO: 535413
  misc_feature: HIJSMM301D3N9E.26.78.H01.1.454.light.4.raw

SEQ ID NO: 555551 - DNA, 501 bp, Homo sapiens
  misc_feature: HIJSMM301DH3CC.21.81.H04.1.454.light.4.raw
tcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacgaggctgattattactgcaggtcatatacaatcagcaacacttatgtcttcgggactgggaccaagatcaccgtcctaggtcagcccaaggccaacccactgtca

SEQ ID NO: 555552 - DNA, 486 bp, Homo sapiens; identical to SEQ ID NO: 540314
  misc_feature: HIJSMM301DIS8Z.16.53.E09.1.454.light.4.raw

SEQ ID NO: 555553 - DNA, 446 bp, Homo sapiens
  misc_feature: HIJSMM301B1IU7.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccgccctcctccatactcgt

SEQ ID NO: 555554 - DNA, 518 bp, Homo sapiens
  misc_feature: HIJSMM301CD1KO.10.38.D05.1.454.light.4.raw
catagtagtgcacgaccggtgctcgatttagtatctgatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccacccaggcaaagcccccaaactccttgtttttgaggtcagtaagcggccctcaggagtccctgatcggttctctgcctccaagtctggcaacacggcctccctgaccgtctctgggctccaggctgaggatgaggctgattactactgcagcgcatattcaggccccaacagggtgtttggcggcgggactaaggtgaccgtcctgggtcagcccaaggctgccccctcggtcactctgttcccgccct

SEQ ID NO: 555555 - DNA, 422 bp, Homo sapiens; identical to SEQ ID NO: 447881
  misc_feature: HIJSMM301DJPJ3.9.34.D01.1.454.light.4.raw

SEQ ID NO: 555556 - DNA, 454 bp, Homo sapiens; identical to SEQ ID NO: 536943
  misc_feature: HIJSMM301DPMJD.19.86.H09.1.454.light.4.raw

SEQ ID NO: 555557 - DNA, 520 bp, Homo sapiens
  misc_feature: HIJSMM301CTKCG.48.87.H10.1.454.light.4.raw
agtatacatacacgaccggtgctcgatttagcagtactgcgttgggtttgggggtagagaagacaggattcaggacaatctccagcatggccggcttccctctcctcctcaccctcctcactcactgtgcagggtcctgggcccagtctgtgttgactcagccaccctcaacgtctgggactcccgggcagaccgtcaccatctcttgttctggcagcagatggaacatcgggagcaattttgttcactggtaccagcaactgccaggagcggcccccaaactcctcatctacaggaatgataagcgaccctcaggggtccctgcccgattctctggctccaagtctggcaccacagcctccctggccatcagaggactccggtccgaggatgagggtgatttttattgtgctgtttgggatgacgacatgaatggttcgattttcggcggagggaccaaactgaccgtcctgggtcagcccaaggctgcccctcggtcactctgttcccgcctcctcta

SEQ ID NO: 555558 - DNA, 498 bp, Homo sapiens; identical to SEQ ID NO: 536977
  misc_feature: HIJSMM301BOR6U.11.75.G09.1.454.light.4.raw

SEQ ID NO: 555559 - DNA, 504 bp, Homo sapiens; identical to SEQ ID NO: 543615
  misc_feature: HIJSMM301AT9S7.11.67.G01.1.454.light.4.raw

SEQ ID NO: 555560 - DNA, 515 bp, Homo sapiens
  misc_feature: HIJSMM301EY2Q4.13.38.D05.1.454.light.4.raw
tcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgtcgtcacggaccgaacggaggaaagtacaagacgaacgtaacgtggcgtgcaccaactactcgtcttctactcttcccgt

SEQ ID NO: 555561 - DNA, 476 bp, Homo sapiens
  misc_feature: HIJSMM301CXQ0U.8.53.E09.1.454.light.4.raw
ctcgcgtgtccacgaccggtgctcgatttagagagagtgtgttgggtttgggggctctgcttcagctgtgggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacacagcctgagtattggctgttcggcggcggacc

SEQ ID NO: 555562 - DNA, 509 bp, Homo sapiens
  misc_feature: HIJSMM301A4QRT.21.22.B11.1.454.light.4.raw
  modified_base (331)..(331): a, c, t, g, unknown or other
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcgagagggtcaccatctcttgttctggaggcaactccaacatcggaagtaattatgtattctggtatcagcaactcccaggaatggcccccaaactcctcatccagaggaataatcagcggccctcaggggtccctnaccgattctctggctccaagtctggcacctcagcctcccctgaccatcagtgggctccggtccgaggatgaggctgactattactgtgcatcacgggacgcaacaatgggatgacaatctgagcgggttgggtggttcggcgggagggaccaaactgaccgtcctaggtcagcccaac

SEQ ID NO: 555563 - DNA, 508 bp, Homo sapiens
  misc_feature: HIJSMM301DD1UI.17.41.D08.1.454.light.4.raw
cgtagactagcacgaccggtgctcgatttagtcacgcgagaaagggaaaggggagagctgctcagttaggacccagagggaaccatggaaaccccagcgcagcttctcttcctcctgctactctggctcccagataccaccggagaaattgtgttgacgcagtctccaggcaccctgtccttgtctccaggggaaacagccaccctctcctgtagggccagtcagagtgtttttaaaaactatttagcctggtaccaacagaagcctggccaggctcccaggctcctcatctatggtgcatccaccagggccactggcatcccagacaggttcagtggcggtgggtctgggacagaattcactctcaccatcaccagtctggagcctgaagattttgctctgtatcactgtcagcaatatggtggtacacccctcactttcggcggaggggccaaggtggagatcaagcgaactgtggctgcaccatctgtcttcatcttcctgccta

SEQ ID NO: 555564 - DNA, 485 bp, Homo sapiens; identical to SEQ ID NO: 549401
  misc_feature: HIJSMM301A36B3.15.28.C06.1.454.light.4.raw

SEQ ID NO: 555565 - DNA, 503 bp, Homo sapiens
  misc_feature: HIJSMM301CERMZ.21.26.C04.1.454.light.4.raw
tcgtcgctcgcacgaccggtgctcgatttagtctagcgactttgggtttggggagagaagagctgctcagttaggacccagagggaaccatggaaaccccagcgcagcttctcttcctcctgctactctggctcccagataccaccggagaaattgtgttgacgcagtctccggacaccctgtctttgtctccaggggaaagagccaccctctcctgcagggccagtcagattgttggcaacaactacttagcctggtaccagcagaaacctggccaggctcccaggctcctcatccatactgcctccaagagggccactggcatccctgacaggttcagtggcagtgggtctgggacagacttcactctcaccatcaccagactggagcctgatgattttgcagtttattactgccaccaacatgctttcgcaccgctcacgttcggcggagggaccagggtggagatcaaacgaactgtggctgcaccatctgtcttcatt

SEQ ID NO: 555566 - DNA, 523 bp, Homo sapiens
  misc_feature: HIJSMM301ERRA2.51.30.C08.1.454.light.4.raw
cgatcgtatacacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgccaaaaagatatgcttattggtaccatcagaagtcaggccaggcccctgtactggtcatctatgaggacaccaaacgaccctccgggatccctacgagattctctggctccagtttagggacagtggccaccctgacaatcagtggggcccaggtgggggagtgagggtgattactactgttactcaacagacattactactactcataggtgttcggcggagggaccaagctgaccgtcctaggtcacgcccaaggctcgccccctcggtccactctcgttcccgccctcctctcg

SEQ ID NO: 555567 - DNA, 520 bp, Homo sapiens
  misc_feature: HIJSMM301CQ86S.17.42.D09.1.454.light.4.raw
cgtagactagcacgaccggtgctcgatttagacacatacgcagggaaagggggccccagctctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccgccct

SEQ ID NO: 555568 - DNA, 462 bp, Homo sapiens
  misc_feature: HIJSMM301BESO8.10.9.A09.1.454.light.4.raw
catagtagtgcacgaccggtgctcgatttagcgagacgcgcagggggaggaactgctcagttaggacccagagggaaccatggaagccccagctcagcttctcttcctcctgctactctggctcccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctgggaccaaagtggagatcaaacgaactgtggctgcaccatctgtcttcatcttcccgccatctgacactctatg

SEQ ID NO: 555569 - DNA, 488 bp, Homo sapiens; identical to SEQ ID NO: 535081
  misc_feature: HIJSMM301C1QDP.26.23.C01.1.454.light.4.raw

SEQ ID NO: 555570 - DNA, 493 bp, Homo sapiens; identical to SEQ ID NO: 542088
  misc_feature: HIJSMM301D46R1.11.71.G05.1.454.light.4.raw

SEQ ID NO: 555571 - DNA, 518 bp, Homo sapiens
  misc_feature: HIJSMM301ATTP7.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggtccgaacggaccgaacggtaggaagtacgaaacgaactagtggcgtgcaccactctgtcttctatcttcccgtcccact

SEQ ID NO: 555572 - DNA, 505 bp, Homo sapiens; identical to SEQ ID NO: 536254
  misc_feature: HIJSMM301DYZWL.7.71.G05.1.454.light.4.raw

SEQ ID NO: 555573 - DNA, 511 bp, Homo sapiens
  misc_feature: HIJSMM301CJO7B.48.81.H04.1.454.light.4.raw
  modified_base (503)..(503): a, c, t, g, unknown or other
agtatacatacacgaccggtgctcgatttagtagtgtagattcgcgggggctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgttttcacacctccatgaacaaggagtacttggcttggttccagcagaaaccagggcagcctcctaaactactcatttactcggcatccacccggaagtccgaggttcctgaccgattccgtggcagcgggtcgtgggacgagattttactctcaccatcactaccctgcaggctgaagatgtggcagtttattactgtcaacaatattattctactccgccgacgttcggccggggaccgaatggaaatcaacgaactgtggctgcaccatctgtcttcancttccccg

SEQ ID NO: 555574 - DNA, 504 bp, Homo sapiens; identical to SEQ ID NO: 535561
  misc_feature: HIJSMM301DXIZ0.4.57.F02.1.454.light.4.raw

SEQ ID NO: 555575 - DNA, 503 bp, Homo sapiens; identical to SEQ ID NO: 550542
  misc_feature: HIJSMM301EDJO1.2.76.G10.1.454.light.4.raw

SEQ ID NO: 555576 - DNA, 441 bp, Homo sapiens; identical to SEQ ID NO: 535074
  misc_feature: HIJSMM301B6NU0.11.3.A03.1.454.light.4.raw

SEQ ID NO: 555577 - DNA, 447 bp, Homo sapiens; identical to SEQ ID NO: 535020
  misc_feature: HIJSMM301AMJFZ.18.9.A09.1.454.light.4.raw

SEQ ID NO: 555578 - DNA, 463 bp, Homo sapiens; identical to SEQ ID NO: 535062
  misc_feature: HIJSMM301EFXXL.11.73.G07.1.454.light.4.raw

SEQ ID NO: 555579 - DNA, 493 bp, Homo sapiens; identical to SEQ ID NO: 536969
  misc_feature: HIJSMM301D4X7S.27.78.H01.1.454.light.4.raw

SEQ ID NO: 555580 - DNA, 494 bp, Homo sapiens; identical to SEQ ID NO: 534994
  misc_feature: HIJSMM301DUGTP.27.78.H01.1.454.light.4.raw

SEQ ID NO: 555581 - DNA, 490 bp, Homo sapiens; identical to SEQ ID NO: 535526
  misc_feature: HIJSMM301A1V1G.26.78.H01.1.454.light.4.raw

SEQ ID NO: 555582 - DNA, 497 bp, Homo sapiens; identical to SEQ ID NO: 536371
  misc_feature: HIJSMM301CTY3X.16.78.H01.1.454.light.4.raw

SEQ ID NO: 555583 - DNA, 495 bp, Homo sapiens
  misc_feature: HIJSMM301CUWOX.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctccacttcgtcggagggacgaacggacggaggatcagacgaactagtggcgtgcaccatctgttcttcta

SEQ ID NO: 555584 - DNA, 513 bp, Homo sapiens
  misc_feature: HIJSMM301DREEV.49.57.F02.1.454.light.4.raw
agtcgagagacacgaccggtgctcgatttagctcgatatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtcccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacataaacacttgggtgttcggcggcgggaccaaactgaccgtcctacgtcagcccaaggctgccccctggtcactctcg

SEQ ID NO: 555585 - DNA, 486 bp, Homo sapiens; identical to SEQ ID NO: 537583
  misc_feature: HIJSMM301BV96K.17.25.C03.1.454.light.4.raw

SEQ ID NO: 555586 - DNA, 507 bp, Homo sapiens
  misc_feature: HIJSMM301DFNUI.53.33.C11.1.454.light.4.raw
cgcgtatacacacgaccggtgctcgatttagagtgagctcgttgggtttgggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaagaaaatatgcttattggtaccagcagaggtcaggccaggcccctgtgctggtcatctatgaggacaccaaacgaccctccgggatccctgcgagattctctggcgccagctcagggacagtggccaccctgacagtcaggtggggcccaggtggaggatgaagctgattactactgttactcaacagacaggagtggaaatcatagggtattcggcggagggaccaaactcgaccgtcctaggtcagcccaaggcctcgcccccgtcggtccta

SEQ ID NO: 555587 - DNA, 485 bp, Homo sapiens; identical to SEQ ID NO: 535880
  misc_feature: HIJSMM301B4886.7.75.G09.1.454.light.4.raw

SEQ ID NO: 555588 - DNA, 484 bp, Homo sapiens; identical to SEQ ID NO: 535400
  misc_feature: HIJSMM301C5AOB.46.26.C04.1.454.light.4.raw

SEQ ID NO: 555589 - DNA, 510 bp, Homo sapiens
  misc_feature: HIJSMM301AD098.51.9.A09.1.454.light.4.raw
cgatcgtatacacgaccggtgctcgatttagcgagacgcgcaggggactgcgggggtaagaggttgtgtccaccatggcctggactcctctcctcctcctgttcctctctcactgcacaggttccctctcgcaggctgtgctgactcagccgtcttccctgtctgcatctcctggagcatcagccagtctcacctgcaccttgcgcagtggcttcgatgttagtacctacaggatatactggttccagcagaaggcagggagtcctccccagtttctcctaaattacaaatctgactcacgtaagcagcagggctctggagtccccagccgcttctctggatccaaagatgcttcggccaatgcggggattttactcatctctgggctccagtctgaggatgaggctgacttattacttgtttgtatttggtcacagcagcgcgttgggtagttcgggcggggggaccgaaactagaccgtcctaggtcagcccgaaggctcgccccccg

SEQ ID NO: 555590 - DNA, 483 bp, Homo sapiens
  misc_feature: HIJSMM301DO6H6.52.77.G11.1.454.light.4.raw
cgcagtacgacacgaccggtgctcgatttagctagtcactcaagggaaaggggagtcccaaccaggacacagcatggacatgagggtccctgctcagctcctggggctcctgctgctctggctctcaggtgccagatgtgtcatccagatgacccagtctccatcctccctgtctgcatctgtaggagacagagtcaccatcacttgccaggcgagtcaggacattagcaactatttaaattggtatcagctgaaacccgggaaagcccctaagctcctgatcctcgatgcattcactttggaaacaggggtcccatcaaggttcagtgggagtggctctgggacagattttactttcaccatcagcagcctgcagcctgaggatattgcaacatattactgtcaacagtacgataatctcccgctcactttcggcgggggaccgaaggtggagatcaacgaactgtggctgcaccatctgtt

SEQ ID NO: 555591 - DNA, 512 bp, Homo sapiens
  misc_feature: HIJSMM301A2FSJ.9.55.E11.1.454.light.4.raw
tgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtgaaagaaacatcattggaggtgttagtgtacactggtaccagcagaagccaggccaggcccctgtgctggtcctccatcatactagcgaccggccctcagggatccctgagcgattctcaggctccaactctgggaaaacggccaccctgaccatcagcagggtcgaagccggggatgaggccgactattactgtcaggtgtgggctggtgataatgatcatgcgggggtgttcggcggagggaccaagctgaccgtcctaagtcagcccaaaggctgccccctccggtcgactcttcg

SEQ ID NO: 555592 - DNA, 480 bp, Homo sapiens; identical to SEQ ID NO: 554452
  misc_feature: HIJSMM301EA7Z7.41.17.B06.1.454.light.4.raw

SEQ ID NO: 555593 - DNA, 514 bp, Homo sapiens
  misc_feature: HIJSMM301DDT54.49.87.H10.1.454.light.4.raw
agtcgagagacacgaccggtgctcgatttagcagtactgcgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaatacccggcaaagtcccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacataaacacttgggtgttcggcggcgggaccaaactgaccgtcctacgtcagcccaaggctgccccctcggtcactctgttcccg

SEQ ID NO: 555594 - DNA, 500 bp, Homo sapiens
  misc_feature: HIJSMM301CZN1T.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcgcaggaccaggtgagtcaagcgaactgtggctgcaccatctgtcttcatcttccgcc

SEQ ID NO: 555595 - DNA, 457 bp, Homo sapiens; identical to SEQ ID NO: 545355
  misc_feature: HIJSMM301EYJYY.18.78.H01.1.454.light.4.raw

SEQ ID NO: 555596 - DNA, 495 bp, Homo sapiens; identical to SEQ ID NO: 541828
  misc_feature: HIJSMM301AZR3H.19.71.G05.1.454.light.4.raw

SEQ ID NO: 555597 - DNA, 488 bp, Homo sapiens
  misc_feature: HIJSMM301C317P.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattactgcatgcaagttctacaaacttcctacacttttggcctaggggaccaagctggagatcaaacgaa

SEQ ID NO: 555598 - DNA, 494 bp, Homo sapiens
  misc_feature: HIJSMM301D8XZF.40.11.A11.1.454.light.4.raw
tctagcgactcacgaccggtgctcgatttagctacgactgcaggggcagcaagatggtgttgcagacccaggtcttcatttttctgttgctctggatctctggtgcctacggggacatcgtgatgacccagtctccagactccctggctgtgtctctgggcgagagggccaccatcaactgcaagtccagccagagtcttttatacaactccaacaagcagcactacttagcttggtaccagcagaaaccaggacagcctcctaaactgctcatttactgggcctctacccgggaatccggggtccctgaccgattcagtggcagcgggtctgggacagatttcactctgaccatcagcagcctgcaggctgaagatgtggcagtttattactgtcaacaatattatattattccgaggacgttcggccaaggaccgaaggtggaaatacaaacgaaactgtggctgcaccatctgtcttcatcttcccgccat

SEQ ID NO: 555599 - DNA, 493 bp, Homo sapiens
  misc_feature: HIJSMM301BO0T1.52.86.H09.1.454.light.4.raw
cgcagtacgacacgaccggtgctcgatttagtgctatagacttgggtttgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgtcactctcg

SEQ ID NO: 555600 - DNA, 479 bp, Homo sapiens; identical to SEQ ID NO: 535118
  misc_feature: HIJSMM301CEESP.13.59.F04.1.454.light.4.raw

SEQ ID NO: 555601 - DNA, 471 bp, Homo sapiens
  misc_feature: HIJSMM301DY2GJ.12.7.A07.1.454.light.4.raw
atacgacgtacacgaccggtgctcgatttagcacgtgtcgcagggggcaggagtcagacccactcaggacacagcatggacatgagggtccccgctcagctcctggggctcctgctgctctggctcccaggtgccacatgtgccatccagatgacccagtctccatcctccctgtctgcatctataggagacagagtcgccatcagttgccgggcaagtcagtacattagaaatgatttagcctggtatcagcagaaaccagggacagcccctcagctcctgatctatgctgcatccaatttacaaactggggtcccatcaaggttcagcggcagtggatctgcaacagacttcaatctcaccatcagcagcctgcagcctgaagattttgcaatttattactgtctgcaggattacacataccctcgaacgttcggccaagggaccaaggtggaaatcaaacgaactagt

SEQ ID NO: 555602 - DNA, 487 bp, Homo sapiens; identical to SEQ ID NO: 535583
  misc_feature: HIJSMM301BCHCT.22.73.G07.1.454.light.4.raw

SEQ ID NO: 555603 - DNA, 499 bp, Homo sapiens
  misc_feature: HIJSMM301C7M0N.2.49.E05.1.454.light.4.raw
acgctcgacacacgaccggtgctcgatttagagcgactagcaacacacaaaggggggaaggctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccgggcagagggtcaccatctcttgttctggaagcatgtccaacatcggaagtgataatgtatactggtaccagcagttcccaagagcggcccccaagctcctcatctatagaaattatgaacggtcctcaggggtccctgaccgattctctggctcccaaagtctggcacctcagcctcccctggccatcagtgggctccggtccgaggatgaggctgattattactgtgttggatgggaccagcagcctgagtgcttatgtcttcggaactgggaccacggtcacgtcct

SEQ ID NO: 555604 - DNA, 491 bp, Homo sapiens
  misc_feature: HIJSMM301B4Q9W.41.17.B06.1.454.light.4.raw
tctatactatcacgaccggtgctcgatttagtcgatagtgaagggggaggaactgctcagttaggacccagacggaaccatggaagccccagcgcagcttctcttcctcctgctactctggctcccagatatcacaggagagatagtgatgacgcagtctccagccaccctgtctctgtctccaggggaaagagcctccctctcctgcagggccagtcagaatattcgcggccacttagcctggtatcagcagaaacctggccaggctcccaggctcctcatctatgctgcatccaccagggccactggtatcccagccaggttcagtggcggtgggtctgggacagagtttactctctccatcagcagactggagcctgaagattttgcaatttattactgtcaccagtatggtagttcacctctaactttcggcggagggaccgaaggtggagatcaaacgaactgtggctgcaccatctgtcttcatt

SEQ ID NO: 555605 - DNA, 490 bp, Homo sapiens
  misc_feature: HIJSMM301CWIOJ.17.34.D01.1.454.light.4.raw
cgtagactagcacgaccggtgctcgatttagatcgtctgtgttgggtttggggtgatcaggacttctcagttcatcttctcaccatgaggctccctgctcagctcctggggctgctaatgctctggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcttagtggcagcgggtcagggacagattttacactgaaaatcagccgggtggaggctgaggacgttggaatttattactgtatgcaaggtatagagcttcctccgacgttcggccaagggaccgaaggtggaactcaaacgaa

SEQ ID NO: 555606 - DNA, 489 bp, Homo sapiens; identical to SEQ ID NO: 535139
  misc_feature: HIJSMM301EZJ4P.14.55.E11.1.454.light.4.raw

SEQ ID NO: 555607 - DNA, 503 bp, Homo sapiens
  misc_feature: HIJSMM301ASXYN.48.25.C03.1.454.light.4.raw
agtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggctcctcatttatgatacatccaccagggccactggtgtcccagccaggttcactggcggtgggtctgggacagagttcactctcaccatcagcagcctgcagtctgaagattttacattttattactgtcagcagtatcgtaagtggactccgacgtttggccaagggaccaaggtggaagtcaaacgactgtggctgcaccatctgtcttcatcttcccgc

SEQ ID NO: 555608 - DNA, 493 bp, Homo sapiens; identical to SEQ ID NO: 544835
  misc_feature: HIJSMM301BY338.43.29.C07.1.454.light.4.raw

SEQ ID NO: 555609 - DNA, 511 bp, Homo sapiens
  misc_feature: HIJSMM301CODEI.15.86.H09.1.454.light.4.raw
tctacgtagccacgaccggtgctcgatttagtgctatagacttgggtttggggggacttccctggtctccttctacctactgcccttcattttctccacaggtctctgcgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctcggtcactctgttcccgccctcctcgctacgt

SEQ ID NO: 555610 - DNA, 494 bp, Homo sapiens; identical to SEQ ID NO: 537607
  misc_feature: HIJSMM301AO6HA.52.10.A10.1.454.light.4.raw

SEQ ID NO: 555611 - DNA, 486 bp, Homo sapiens; identical to SEQ ID NO: 535043
  misc_feature: HIJSMM301A64J8.46.35.D02.1.454.light.4.raw

SEQ ID NO: 555612 - DNA, 502 bp, Homo sapiens; identical to SEQ ID NO: 546060
  misc_feature: HIJSMM301C3Y91.19.67.G01.1.454.light.4.raw

SEQ ID NO: 555613 - DNA, 477 bp, Homo sapiens
  misc_feature: HIJSMM301ATGK7.26.72.G06.1.454.light.4.raw
agactatactcacgaccggtgctcgatttagctacgactgcaagggaaagggtgagatccctcactgtggctcactttcagcggagggaccacggtggagatcacacgtaagtgcactttcctaatgctttttcttataaggttttaagtttggagcgtttttgtgtttgagatgttagctcaggtcaattccaaagagtaccagattctttcaaaaagtcagatgagtaagggatagaaaattagttcaccttaaggaacagccaagcgctagccagttaagtgaggcatctcaattgcaaggttttctctgcatcggtcaggttagtgatattaacagcgaaaagagatttttgttaaggggaaagtaatgaagttaacactgtggatcaccttcggccaagggacacgactggagattaaacgaactgtggctgcaccatctgtcttcatcttcccgccatctgaagtaagtct

SEQ ID NO: 555614 - DNA, 485 bp, Homo sapiens; identical to SEQ ID NO: 543370
  misc_feature: HIJSMM301DREIO.3.10.A10.1.454.light.4.raw

SEQ ID NO: 555615 - DNA, 517 bp, Homo sapiens; identical to SEQ ID NO: 541955
  misc_feature: HIJSMM301D9O8V.22.30.C08.1.454.light.4.raw

SEQ ID NO: 555616 - DNA, 504 bp, Homo sapiens
  misc_feature: HIJSMM301DTR8G.5.86.H09.1.454.light.4.raw
atcagacacgcacgaccggtgctcgatttagtgctatagacttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaagctgaccgtcctaggtcagcccaaggctgccccctcggtcta

SEQ ID NO: 555617 - DNA, 508 bp, Homo sapiens; identical to SEQ ID NO: 541396
  misc_feature: HIJSMM301D6FLE.17.33.C11.1.454.light.4.raw

SEQ ID NO: 555618 - DNA, 447 bp, Homo sapiens
  misc_feature: HIJSMM301DR06S.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccgccccctccactactcgta

SEQ ID NO: 555619 - DNA, 487 bp, Homo sapiens
  misc_feature: HIJSMM301DM5Y0.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagtaacttttggccaggggaccaagctggagatcaaacgaactgtggctgcaccat

SEQ ID NO: 555620 - DNA, 486 bp, Homo sapiens
  misc_feature: HIJSMM301C3KZY.52.23.C01.1.454.light.4.raw
cgcagtacgacacgaccggtgctcgatttagtacacgtgattagggattgggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaactatttaaattggtatcagcagaaaccagggaaagcccctaaactcctgatctacgatgcatccaatttggagacaggggtcccatcaaggttcactggaagtggatctgggacacattttactttcaccatcagcggcctgcagcctgaagattttgcaacatattactgtcaacaatatgaagatctccccctctactttcggcggagggaccaaggtggagatcagacgaactgtgctgcacc

SEQ ID NO: 555621 - DNA, 472 bp, Homo sapiens
  misc_feature: HIJSMM301BGZAT.3.82.H05.1.454.light.4.raw
agacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgcggttttaacagatggttagtctggtatcagcagaaaccagggaaagcccctgagttcctgatgtctgctgcatccaccctgcaaagtggagtcccatccagattcagcgtcagtgaatctgggacagagttcactctcaccatcagcagcctgcagcctgaagattttgcaacttactattgtcaacaggctgacagtctcccgctcactttcggcggagggaccgaaggtggagatcaaacgaactgtgg

SEQ ID NO: 555622 - DNA, 520 bp, Homo sapiens
  misc_feature: HIJSMM301D16C9.49.10.A10.1.454.light.4.raw
agtcgagagacacgaccggtgctcgatttagcgtcgatctcaggggctgggcctaaggaagcagcactggtggtgcctcagccatggcctggaccgttctcctcctcggcctcctctctcactgcacagactctgtgacctcctatgttctgactcagccgccctcggcgtcagtggccccaggacagacggccacgattccctgtaggggagacgacattggagggaaagctgtgcattggtaccagcagaagccaggccaggcccctgagctggtcctccatggtgatagcgaccggccctcaggaatccctgagagattctccggctccaactctggggagatggccaccctgaccattaccagggccgaagccgggggatggaggccgactattactgtcaggtgtgggatagtgatacggaccattgggtgttcggcggagggaccaaggtgaccgtcctaggtcagcccaaggctgccccctcggtcactctgttcccaccctcctctctctcg

SEQ ID NO: 555623 - DNA, 445 bp, Homo sapiens; identical to SEQ ID NO: 537719
  misc_feature: HIJSMM301EE3PQ.47.85.H08.1.454.light.4.raw

SEQ ID NO: 555624 - DNA, 495 bp, Homo sapiens
  misc_feature: HIJSMM301DKFIH.12.23.C01.1.454.light.4.raw
atacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaagagccaccctctcctgcagggccagtcagagtgttaatagcgacttagcctggtaccagcagatacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcagcagtataataactggttcctgctcactttcggcgggggaccgaaggtggaggatcaaacgaactgtggctgcaccatctgtt

SEQ ID NO: 555625 - DNA, 490 bp, Homo sapiens
  misc_feature: HIJSMM301B4KPY.15.83.H06.1.454.light.4.raw
  modified_base (485)..(485): a, c, t, g, unknown or other
tctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaaattggtatcagcagaaaccagggaaagcccctaagctcctgatctatggtgcatccagtttgcaaagtggggccccatcaaggttcagtggcagtggctctgggacagatttcactctcaccatcagcagtctccaacctgaagattttgcaacttactactgtcaacagagtttcagtagtccccggacgtcgtccaggaccgaaggtaggacatcaacgaactagtggctgcaccatcngtctt

SEQ ID NO: 555626 - DNA, 443 bp, Homo sapiens; identical to SEQ ID NO: 551033
  misc_feature: HIJSMM301D7DWI.14.76.G10.1.454.light.4.raw

SEQ ID NO: 555627 - DNA, 486 bp, Homo sapiens
  misc_feature: HIJSMM301DC07Y.14.55.E11.1.454.light.4.raw
  modified_base (427)..(427): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctnactttcggcggaggccaaggcgagatcagacgaactgtggctgcaccatctgtcttcta

SEQ ID NO: 555628 - DNA, 355 bp, Homo sapiens
  misc_feature: HIJSMM301B881A.19.22.B11.1.454.light.4.raw
tactctcgtgcacgaccggtgctcgatttagacgacagctcaggggcagcaagatggtgttgcagacccaggtcttcatttctctgttgctctggatctctggtgtcttcggggacatcgtgatgacccagtctccagactccctggctgtgtctctgggcgagagggccaccatcaactgcaagtccagccagaatattttatacaactccaataataagaactacttagcttggttccagcagaaaccaggacagcctcctaagatgcttcttttattgggcatctgcccgggaatccggggtccctgaccgattcagtggcagcgggtctgggacagatttcactctcacca

SEQ ID NO: 555629 - DNA, 501 bp, Homo sapiens
  misc_feature: HIJSMM301D4Q6G.43.34.D01.1.454.light.4.raw
tgtgagtagtcacgaccggtgctcgatttagatcgtctgtgttgggtttgggggctttgcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaaccccactgtcactctgttcccaccctcctcactacctcacta

SEQ ID NO: 555630 - DNA, 506 bp, Homo sapiens; identical to SEQ ID NO: 535058
  misc_feature: HIJSMM301BQAD7.17.41.D08.1.454.light.4.raw

SEQ ID NO: 555631 - DNA, 489 bp, Homo sapiens; identical to SEQ ID NO: 535139
  misc_feature: HIJSMM301EHY8G.14.55.E11.1.454.light.4.raw

SEQ ID NO: 555632 - DNA, 456 bp, Homo sapiens
  misc_feature: HIJSMM301BI4TB.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaaagggtccctgaccgattctctggcgagaggtctggcgcctcagcttccctggccatcagagggctccagtctgaagatgaggctgattattactgtgcaatctgggatgacagtgtgaacggtccggttttcggcggaggggaccaaggctgaccgtcctaagtcagcccaaggctgccccctcggtcactctgttcccaccctctccacgagagta

SEQ ID NO: 555633 - DNA, 487 bp, Homo sapiens
  misc_feature: HIJSMM301B5TGO.9.75.G09.1.454.light.4.raw
tgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttccaccctgtctgcatctgtgggagacagagtcaccatctcttgccgggccagtcagaatgttcttagttggttggcctggtatcagcagaaaccggggaaagcccctaaactcttgatctatgaggcctctggtttacaaagtggggtcccatcaagattcagcggcagtggatctgggacagaattcactctcaccatcagcagtctgcagcctgatgattttgcaacttattactgccaacagtataatagttatccgtggacatttggccaagggaccgaggtggaagtcaaacgaactgtggctgcaccatctgtcttcat

SEQ ID NO: 555634 - DNA, 493 bp, Homo sapiens
  misc_feature: HIJSMM301BQM94.43.82.H05.1.454.light.4.raw
tgtgagtagtcacgaccggtgctcgatttagtcgagctctctcgcggggcagcttcagctgtgggtagagaagacaggactcaggacaatctccagcatggccagcttccctctcctcctcgccctcctcactcactgtgcagggtcctgggcccagtctgtcctgactcagccaccctcagcgtctgggacccccgggcagagggtcaccatctcttgttctggaagcagctccaacatcggaagtaatactgtaaactggtaccagcagctcccaggaacggcccccaaactcctcatctacagtattaatcagcggccctcagggatccctgaccgattctctggctccaagtctggcgcctcagcctccctggccatcagtgggctccagtctgaggatgaggctgattattactgtgctgcatgggatgacagcctgaatgcttgggtgttcggcggagggaccaaggctgaccgtcctaggtcacgg

SEQ ID NO: 555635 - DNA, 504 bp, Homo sapiens
  misc_feature: HIJSMM301CF0RC.15.66.F11.1.454.light.4.raw
tctacgtagccacgaccggtgctcgatttagtcacgcgagaagggggggtcgtcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaagcccccaaagtcatcatttatgagctcactaagcggccctcaggggtccctgatcgcttctctggctccaagtctggcgactcggcctccctgaccgtctctgggctccagcctgaagatgaggctgattatttctgcggctcatatggagacaattacagctttgtcttcggaagtgggaccaaggtcaccgtcctaagtcagcccaaggccaacccactgtcactctgttcccaccct

SEQ ID NO: 555636 - DNA, 501 bp, Homo sapiens; identical to SEQ ID NO: 537545
  misc_feature: HIJSMM301C5DYK.49.69.G03.1.454.light.4.raw

SEQ ID NO: 555637 - DNA, 481 bp, Homo sapiens; identical to SEQ ID NO: 535061
  misc_feature: HIJSMM301DKSHG.16.81.H04.1.454.light.4.raw

SEQ ID NO: 555638 - DNA, 492 bp, Homo sapiens
  misc_feature: HIJSMM301EHJX0.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcccgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatacaaacgaactgtggctgcaccatctgtt

SEQ ID NO: 555639 - DNA, 496 bp, Homo sapiens
  misc_feature: HIJSMM301COYQE.22.14.B03.1.454.light.4.raw
  modified_base (492)..(492): a, c, t, g, unknown or other
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcggccaaggaccaaggtggaaatcaaacgaactgtggctgnacca

SEQ ID NO: 555640 - DNA, 510 bp, Homo sapiens
  misc_feature: HIJSMM301BE68X.17.28.C06.1.454.light.4.raw
cgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccagggctgaccgtcctaagtcagcccaaggctgccccctc

SEQ ID NO: 555641 - DNA, 488 bp, Homo sapiens
  misc_feature: HIJSMM301A72WQ.51.6.A06.1.454.light.4.raw
cgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgattctctggctccacctcagggacaatggtcacattgaccatcagtggagtccaggcagaagacgaggctgactatttctgtcaatcttcagacatcagtggtacttatgtcttcggaactgggaccaaggtcaccgtcctaggtcagcccaaggccaacccactgtcact

SEQ ID NO: 555642 - DNA, 485 bp, Homo sapiens
  misc_feature: HIJSMM301DPLVZ.43.76.G10.1.454.light.4.raw
tgtgagtagtcacgaccggtgctcgatttagtcactcatacagggggcgggggtaagaggttgtgtccaccatggcctggactcctctcctcctcctgttcctctctcactgcacaggttccctctcgcaggctgtgctgactcagccgtcttccctctctgcatctcctggagcatcagccagtctcacctgcaccttgcgcagtggcatcaatgttgctacccacacaatatactggtaccagcagaagtcagggagtcctccccagtttctcctgaggtacaaatcagactcagataagcagcagggctctggaatccccagccgcttctctggatccaaggatgcttcggccaatgcaggaattttgctcatctctgggctccagtctgaggatgaggctgactattactgtacgatttggcacaacgacgctgtggttttcggcggagggaccaagctgaccgtcctaagtcagaccccg

SEQ ID NO: 555643 - DNA, 476 bp, Homo sapiens; identical to SEQ ID NO: 547851
  misc_feature: HIJSMM301BCDQP.13.76.G10.1.454.light.4.raw

SEQ ID NO: 555644 - DNA, 490 bp, Homo sapiens; identical to SEQ ID NO: 535420
  misc_feature: HIJSMM301DS7J2.3.72.G06.1.454.light.4.raw

SEQ ID NO: 555645 - DNA, 492 bp, Homo sapiens; identical to SEQ ID NO: 537246
  misc_feature: HIJSMM301CDLRB.43.28.C06.1.454.light.4.raw

SEQ ID NO: 555646 - DNA, 494 bp, Homo sapiens; identical to SEQ ID NO: 534992
  misc_feature: HIJSMM301B7K0J.9.1.A01.1.454.light.4.raw

SEQ ID NO: 555647 - DNA, 466 bp, Homo sapiens; identical to SEQ ID NO: 535366
  misc_feature: HIJSMM301AOMSC.13.4.A04.1.454.light.4.raw

SEQ ID NO: 555648 - DNA, 485 bp, Homo sapiens; identical to SEQ ID NO: 542735
  misc_feature: HIJSMM301DH0CR.26.45.E01.1.454.light.4.raw

SEQ ID NO: 555649 - DNA, 478 bp, Homo sapiens
  misc_feature: HIJSMM301DPHUY.48.5.A05.1.454.light.4.raw
agtatacatacacgaccggtgctcgatttagatagatagacagggggagtcagacccagtcaggacacagcatggacatgagggtccccgctcagctcctggggctcctgctgctctggctcccaggtgccaaatgtgacatccagatgacccaggctccttccaccctgtctgcatctgtaggagacagagtcaccatcacttgccgggccagtcagagtattgttagctggttggcctggtatcaacagagaccagggaaagcccctaaactcctgatctatacggcatctactttacagagtggggtcccatcaaggttcagcggcagtgcatctgggacagaattcactctcaccatcagcagcctgcagcctgatgattttgcaacttattactgccaacagtattatacttatccatggacgttcggccaagggaccaaggtggaaatcaaacgaaactgtggctgcaccat

SEQ ID NO: 555650 - DNA, 494 bp, Homo sapiens; identical to SEQ ID NO: 535629
  misc_feature: HIJSMM301DJ4LE.4.27.C05.1.454.light.4.raw

SEQ ID NO: 555651 - DNA, 485 bp, Homo sapiens; identical to SEQ ID NO: 536576
  misc_feature: HIJSMM301AURR7.46.35.D02.1.454.light.4.raw

SEQ ID NO: 555652 - DNA, 503 bp, Homo sapiens
  misc_feature: HIJSMM301D23JL.49.30.C08.1.454.light.4.raw
agtcgagagacacgaccggtgctcgatttagtctgacgtcaaagggaaagggggcatgagcaaaactgacaagtcaaggcaggaagatgtcgccatcacaactcattgggtttctgctgctctgggttccagcctcctggggtgaagttgtgctgactcagtctccagactttcactctgtgaccccaaaggagaaagtcaccatcacctgccgggccagtcagaacattggtaataacttacactggtaccagcagaaaccagatcagtctccaaagctcctcatcaaatttgctacccagtccttctcaggggtcccctcgaggttcagtggcagtggatctgggacagacttcaccctcaccatcagtagcctggaacctgaagatgctgcagcgtattactgtcatcagactattactttaccggagactttcggccaagggaccaaggtggaaatcaaagaactgtggctgcaccatctgtcttcatcttcccgccat

SEQ ID NO: 555653 - DNA, 504 bp, Homo sapiens
  misc_feature: HIJSMM301C4YZK.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagtagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaacccactgtcact

SEQ ID NO: 555654 - DNA, 511 bp, Homo sapiens
  misc_feature: HIJSMM301APZ3L.14.7.A07.1.454.light.4.raw
cgtctagtaccacgaccggtgctcgatttagcacgtgtcgcagggggccctgaggaaaacaaaccccagctgggaagcctgagaacacttagccttcatgagtgtccccaccatggcctgcatgatgcttctcctcggactccttgcttatggatcaggagtggtttctcagactgtggtgacccaggaaccatcgttctcagtgtcccctggagagacaatcacactcacttgtggcttagactctggctcagtctccaccgctcattatcccagctggtaccggcagaccccaggccaggctccacggctcctcatttacagcacaaagaatcggtcttttggggtccctgatcgcttctctggctccatccttgggaacaaggctgccctcaccatcacgggggcccaggcagatgatgaatctaattatcactgtgcgttgtatatggttttggcatttcggtgttcggcggagggacccaggtgaccgtcctacgtcagcccaagg

SEQ ID NO: 555655 - DNA, 502 bp, Homo sapiens; identical to SEQ ID NO: 541971
  misc_feature: HIJSMM301A6MWC.4.39.D06.1.454.light.4.raw

SEQ ID NO: 555656 - DNA, 476 bp, Homo sapiens; identical to SEQ ID NO: 538611
  misc_feature: HIJSMM301DSKT0.7.81.H04.1.454.light.4.raw

SEQ ID NO: 555657 - DNA, 484 bp, Homo sapiens
  misc_feature: HIJSMM301EJWDH.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgataactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtccaagaactttggccaggggaccaagctggagatcaaacgaactgtggctgcaccat

SEQ ID NO: 555658 - DNA, 500 bp, Homo sapiens; identical to SEQ ID NO: 548721
  misc_feature: HIJSMM301CU72Q.14.35.D02.1.454.light.4.raw

SEQ ID NO: 555659 - DNA, 473 bp, Homo sapiens; identical to SEQ ID NO: 535262
  misc_feature: HIJSMM301AW2YB.8.67.G01.1.454.light.4.raw

SEQ ID NO: 555660 - DNA, 478 bp, Homo sapiens; identical to SEQ ID NO: 535129
  misc_feature: HIJSMM301DWUK5.11.11.A11.1.454.light.4.raw

SEQ ID NO: 555661 - DNA, 493 bp, Homo sapiens; identical to SEQ ID NO: 539456
  misc_feature: HIJSMM301CQZ6K.10.79.H02.1.454.light.4.raw

SEQ ID NO: 555662 - DNA, 471 bp, Homo sapiens
  misc_feature: HIJSMM301C0LNB.4.54.E10.1.454.light.4.raw
agcactgtagcacgaccggtgctcgatttagatcgtagcagaacacacaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcagcatcacttgccgggcaagtcagagcattagcacttttttaagttggtatcagcagacaccagggaaagcccctaagctcctgatctatgctgcttccagtttgcaaagtggggtcccatcaaggttcagtggcagtggatctgggacagatctcactctcactgtcagcagtctgcaatttgaagattttgcaacttactactgtcaacagagtttcagtatcccttggactttcggccaagggaccaaggtggaatcaaacgaac

SEQ ID NO: 555663 - DNA, 423 bp, Homo sapiens
  misc_feature: HIJSMM301AJ9BY.41.9.A09.1.454.light.4.raw
tctatactatcacgaccggtgctcgatttagcgagacgcgcagggcacgaccggtgctcgatttagatcgtctgtgttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaaactttcggtcggagggaccgaaggtaggagatcaaacgaaactgtggctgcaccatctgtcttcatcttcccgccatctgaatagtataga

SEQ ID NO: 555664 - DNA, 499 bp, Homo sapiens
  misc_feature: HIJSMM301D0IEO.40.42.D09.1.454.light.4.raw
tctagcgactcacgaccggtgctcgatttagacacatacgcagggaaagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagaagcattgccaaaaaaatatgcttattggtaccaacagaagtcaggccaggcccctgtgctggtcatctatgaggacaacaaacgaccctccgagatccctgagagattctctggctccagctcagggacaatggccaccttggctctcagtggggcccaggtggaggatgaagctgactactactgttactcagtggacagcagtggaaatcatggggtattcggcggagggaccaagctgaccgtcctaggtcagcccaaggctgccccctcggtca

SEQ ID NO: 555665 - DNA, 504 bp, Homo sapiens
  misc_feature: HIJSMM301A44K0.3.79.H02.1.454.light.4.raw
  modified_base (492)..(492): a, c, t, g, unknown or other
agacgcactccacgaccggtgctcgatttagtgtcacacgaagggaaagggggggtcgtcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacggtgatttttatatctctgtctcctggtaccaacaacacccagacaaagcccccaaactcatcatttatgatgtcactgctcggccctcaggggtttctcatcgcttttctggctccaagtctggcaccacggcctccctgaccatctcgggctccaggctgaggacgaggctgcttattactgcagctcatatacaaggagcaccactctcgtggtatttggtggagggaccaagctgaccgtcctaggtcagccaaggntgccccctcggt

SEQ ID NO: 555666 - DNA, 484 bp, Homo sapiens; identical to SEQ ID NO: 537689
  misc_feature: HIJSMM301CKKOB.19.71.G05.1.454.light.4.raw

SEQ ID NO: 555667 - DNA, 505 bp, Homo sapiens
  misc_feature: HIJSMM301E02HZ.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaatagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaagtggatatcaaacgaactgtggctgcaccatctgtctt

SEQ ID NO: 555668 - DNA, 499 bp, Homo sapiens
  misc_feature: HIJSMM301E23QC.22.5.A05.1.454.light.4.raw
  modified_base (486)..(486): a, c, t, g, unknown or other
acatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccgaggggaaagagcccaccctctcctgcagggccagtcagagtgttaactactacttagcctggtaccaacagaaacctggccaggctcccaggctcctcatctatgatgcatcttacagggccactggcatcccagccaggttcagtggcagtgggtctgggacagacttcactctcaccatcagcagcctagagcctgaagattttgcagtttattactgtcagcagcgtagcaactccctcacgttcggcggagggaccaaggtggagatcaaacgaactgtggctgcaccatctgtcttnatcttcccgccat

SEQ ID NO: 555669 - DNA, 506 bp, Homo sapiens
  misc_feature: HIJSMM301EHR88.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcgccaacgggaccaaggtggaaagtacaaacgaactagtggctgcaccatctgtcttctatcttccccg

SEQ ID NO: 555670 - DNA, 523 bp, Homo sapiens
  misc_feature: HIJSMM301BSA98.49.9.A09.1.454.light.4.raw
  modified_base (329)..(329): a, c, t, g, unknown or other
agtcgagagacacgaccggtgctcgatttagcgagacgcgcaggggagtctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacagcgaccggccctcagggatccctgagcgattttcnggctccaagtctgggaacacggccacctgaccgtcagcagggtcgaagccggggatgaggccgactatatctgtcaggtgtgggatagtagtagtgctcgttccgggggtgttcggcggagggaccaaggttgaccgtcgttggtcagcccaaggctgccccctggtcactctgttcccacctcctctctctcg

SEQ ID NO: 555671 - DNA, 506 bp, Homo sapiens
  misc_feature: HIJSMM301D6T0F.8.28.C06.1.454.light.4.raw
ctcgcgtgtccacgaccggtgctcgatttagagctcacgtattggggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactgtggctgcaccatctgtcttcatcttcccgcc

SEQ ID NO: 555672 - DNA, 504 bp, Homo sapiens; identical to SEQ ID NO: 538940
  misc_feature: HIJSMM301ADHOW.2.35.D02.1.454.light.4.raw

SEQ ID NO: 555673 - DNA, 492 bp, Homo sapiens
  misc_feature: HIJSMM301B4ELV.13.56.F01.1.454.light.4.raw
tcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccaggggaaagagccaccctctcctgcagggccagtcagacagttagcaacaacgtagcctggtaccagcagaaacgtggccaggctcccaggctcctcatctatggtgcatccaccagggccactggtatcccagaccggttcagtggcagtgggtctgggacagacttcactctcaccatcagcagtctgcagtctgaagattttgcagtttattactgtcagcagtataataactggcctcgtacatgtacacttttggccaggggaccaacctggagatcagacgaa

SEQ ID NO: 555674 - DNA, 469 bp, Homo sapiens
  misc_feature: HIJSMM301AG2KG.3.68.G02.1.454.light.4.raw
agacgcactccacgaccggtgctcgatttagtcgatagtgaagggaaaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagtgttagcagctatttaaattggtatcagcagaaaccagggaaagcccctaagctcctgatctatgctgcatccactttgcatggtggggtcccatcaagcttcagtggcagtggatctgggacagatttcactctcaccatcagcaatctgcaacctgaagattttgcaacttactactgtcaacagagttacagtacccctccgacttttggccaggggaccaagctggagatcaaacgaa

SEQ ID NO: 555675 - DNA, 497 bp, Homo sapiens; identical to SEQ ID NO: 540789
  misc_feature: HIJSMM301CQW0M.9.67.G01.1.454.light.4.raw

SEQ ID NO: 555676 - DNA, 494 bp, Homo sapiens; identical to SEQ ID NO: 534994
  misc_feature: HIJSMM301D49K7.27.78.H01.1.454.light.4.raw

SEQ ID NO: 555677 - DNA, 443 bp, Homo sapiens; identical to SEQ ID NO: 544936
  misc_feature: HIJSMM301CD4OX.2.76.G10.1.454.light.4.raw

SEQ ID NO: 555678 - DNA, 503 bp, Homo sapiens
  misc_feature: HIJSMM301BWCFI.49.83.H06.1.454.light.4.raw
agtcgagagacacgaccggtgctcgatttagatcacgtgcgtcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaactcatcatttatgaggccgatcagcggccctcaggggtctctgatcgcttctctggctccacgtctggcagcacggcctccctgacaatctctgggctccaggctggggacgaggctgattattattgctgttcatatgccggtgatagtggccgaagggtgttcggcggagggaccaaggtgaccgtcctaggtcagcccaaggctgccccctcggt

SEQ ID NO: 555679 - DNA, 488 bp, Homo sapiens; identical to SEQ ID NO: 551150
  misc_feature: HIJSMM301CW026.13.87.H10.1.454.light.4.raw

SEQ ID NO: 555680 - DNA, 447 bp, Homo sapiens; identical to SEQ ID NO: 535020
  misc_feature: HIJSMM301AIHRQ.18.9.A09.1.454.light.4.raw

SEQ ID NO: 555681 - DNA, 498 bp, Homo sapiens
  misc_feature: HIJSMM301EE82Z.13.36.D03.1.454.light.4.raw
tcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtgggggaaacaacattggaagtaaaagtgtgcactggtaccagcagaagccaggccaggcccctgtgctggtcgtctatgttgatagcgaccggccctcagggatccctgagcgattctcgggctccaactctgggaacacggccactctgaccatcagcgggacccaggctatggatgaggctgactattactgtcaggcgtgggacagcagcactgcccgctatgtcttcggaactgggaccaaggtcaccgtcctaagtcagcccaaggccaacccact

SEQ ID NO: 555682 - DNA, 492 bp, Homo sapiens
  misc_feature: HIJSMM301DX9TB.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccatcagggccactggtatcccagccaggttcagtggcagtgggtctgggacagagttcactctcaccatcagcagcctgcagtctgaagattttgcggtttattactgtcagcagtataataactggcctccacggtacacttttggccaggggaccaagctggagatcaaacgaactgtggctgcaccat

SEQ ID NO: 555683 - DNA, 496 bp, Homo sapiens
  misc_feature: HIJSMM301B4T56.40.4.A04.1.454.light.4.raw
tctagcgactcacgaccggtgctcgatttagagtagtgatcagggggagctacaacaggcaggcaggggcagcaagatggtgttgcagacccaggtcttcatttctctgttcctctggatctctggtgccttcggggacatcgtgatgacccagtctccagactccctggctctgtctctgggcgagagggccaccatcaactgcaagtccagccagagcgttttatccacttcctacaatcagaattacttagcttggtatcagcataaaccagggcagcctccgaggctgctcatttactggacatctatccgggaatccggggtccctgaccgattccgtggcagtgggtctgggacagattttactctcaccatcaccagccttcaggctgaagatgtggcagtttattactgtcaccaatatttagacattcctccgacgttcggcaaggaccaagtggagatcaacgaactagtggctgcaccatctgtt

SEQ ID NO: 555684 - DNA, 509 bp, Homo sapiens
  misc_feature: HIJSMM301B7XQX.48.78.H01.1.454.light.4.raw
agtatacatacacgaccggtgctcgatttagtgtgagtagtttgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactcggcctctcacgttcggcggagggaccaagggtggacatacaaacgaactgtggctgcaccatctgtcttcacttccttcccg

SEQ ID NO: 555685 - DNA, 486 bp, Homo sapiens; identical to SEQ ID NO: 542293
  misc_feature: HIJSMM301CH9UT.41.10.A10.1.454.light.4.raw

SEQ ID NO: 555686 - DNA, 493 bp, Homo sapiens
  misc_feature: HIJSMM301A8ODU.51.27.C05.1.454.light.4.raw
cgatcgtatacacgaccggtgctcgatttagacgcgatcgaagggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggatccctgagcgattctctggctccaactctgggaacacagccactctgaccatcagcgggacgcaggctgtggatgaggctgacttttactgtcaggcgtgggacagcgacactgccgtgttcggcgggggaccgaagctgaccgtcctcggtcagcccaaggctgccccctccggtca

SEQ ID NO: 555687 - DNA, 522 bp, Homo sapiens; identical to SEQ ID NO: 541090
  misc_feature: HIJSMM301D53PJ.27.23.C01.1.454.light.4.raw

SEQ ID NO: 555688 - DNA, 496 bp, Homo sapiens
  misc_feature: HIJSMM301A327F.15.25.C03.1.454.light.4.raw
tctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggttctaatcgggcctccggggtccctgacaggttcagtggcagtggatcaggcatagattttacactgaaaatcagcagagtggaggctgaggacgttggggtttattactgcatgcaaggtctacaaaccccgatcaccttcggccgagggacacgcctggagattaaacgaactgtggctgcac

SEQ ID NO: 555689 - DNA, 524 bp, Homo sapiens; identical to SEQ ID NO: 551311
  misc_feature: HIJSMM301EBIO3.17.31.C09.1.454.light.4.raw

SEQ ID NO: 555690 - DNA, 487 bp, Homo sapiens
  misc_feature: HIJSMM301A50ZL.43.50.E06.1.454.light.4.raw
tgtgagtagtcacgaccggtgctcgatttagatctactgacaacacacaaggggaggagtcagtctcagtcaggacacagcatggacatgagggtccccgctcagctcctggggctcctgctactctggctccgaggtgccagatgtgacatccagatgacccagtctccatcctccctgtctgcatctgtcggagacagagtcaccatcacttgccgggcaagtcagagcattaggacctatctaaattggtatcagcagaaaccagggaaagtccctgaggtcctcatctatggtgcatccagtttgccaagtggggtcccagcaaggttcagtggcagtggatctgggacagatttcactctcaccatcagcagtctacaacctgaagattttgcaacttactactgtcaacagagtttcagtacccctctgacgttcggccaagggaccaaggtggaaataaaacgaactagtggctgcacca

SEQ ID NO: 555691 - DNA, 494 bp, Homo sapiens
  misc_feature: HIJSMM301EXLEA.4.72.G06.1.454.light.4.raw
agcactgtagcacgaccggtgctcgatttagctacgactgcaagggaaagggggaggaactgctcagttaggacccagacggaaccatggaagccccagcgcagcttctcttcctcctgctactctggctcccagaaagcagtggagaagtagtgatgacgcagtctccagccaccctgcctgtgtctccaggggacactgccaccctctcctgcagggccagtcagagtgttggcactaatttagcctggtaccagcagaaacctggccaagctcccaggctgctcatctataatacaatcacaagggacattggtgtcccagacaggttcagcggcagtgggtctgggacagagttcactctcactatcagcagcctgcactttgaagattttgcagtctatcattgtcagcagtataattggtggcctcggacgttcggtccaacgggaccgaacggtaggaaagtacaaacgaactagtggctgcaccat

SEQ ID NO: 555692 - DNA, 493 bp, Homo sapiens; identical to SEQ ID NO: 535084
  misc_feature: HIJSMM301CYV4M.47.64.F09.1.454.light.4.raw

SEQ ID NO: 555693 - DNA, 494 bp, Homo sapiens; identical to SEQ ID NO: 534992
  misc_feature: HIJSMM301AEU6U.9.1.A01.1.454.light.4.raw

SEQ ID NO: 555694 - DNA, 463 bp, Homo sapiens; identical to SEQ ID NO: 549301
  misc_feature: HIJSMM301E29CB.11.73.G07.1.454.light.4.raw

SEQ ID NO: 555695 - DNA, 510 bp, Homo sapiens; identical to SEQ ID NO: 548804
  misc_feature: HIJSMM301A8EPL.11.57.F02.1.454.light.4.raw

SEQ ID NO: 555696 - DNA, 444 bp, Homo sapiens; identical to SEQ ID NO: 534993
  misc_feature: HIJSMM301ELKDE.5.9.A09.1.454.light.4.raw

SEQ ID NO: 555697 - DNA, 464 bp, Homo sapiens; identical to SEQ ID NO: 537982
  misc_feature: HIJSMM301DQAPN.17.28.C06.1.454.light.4.raw

SEQ ID NO: 555698 - DNA, 494 bp, Homo sapiens; identical to SEQ ID NO: 534992
  misc_feature: HIJSMM301CMWBF.9.1.A01.1.454.light.4.raw

SEQ ID NO: 555699 - DNA, 496 bp, Homo sapiens
  misc_feature: HIJSMM301EBYZZ.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagttgatcaccttcggccaagggacacgactggagattaaacgaactgtggctgcaccatctgtctta

SEQ ID NO: 555700 - DNA, 485 bp, Homo sapiens
  misc_feature: HIJSMM301BJFH8.40.84.H07.1.454.light.4.raw
tctagcgactcacgaccggtgctcgatttagcagacgtctgtcgcgggggaggaactgctcagttaggacccagacggaaccatggaagccccagcgcagcttctcttcctcctgctactctggctcccagataccactggagaaatagtgctgacgcagtctccagccaccctgtctgtgtctccgaggggaaagaggcaccctctcctgcagggccagtcagagtgttgccaccaacttagcctggtaccagcagaaacctggccagcctcccaggctcctcatctatcgtgcatccaccagggccactggtatcccagccaggttcagtggcagtgggtctgggacagacttcactctcaccatcagcagcctgcagtctgaagattttgctagtttatttctgtcagcagtattataacgtgggtgctcactttcggcgggagggaccaaggtggagatcaagcgaactgtggctgcacat

SEQ ID NO: 555701 - DNA, 497 bp, Homo sapiens
  misc_feature: HIJSMM301CKW4B.19.71.G05.1.454.light.4.raw
tactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagttattattgtcaacaatattattatacttcgtggacgttcggccaagggaccgaaaggtggatatcagacgaaactgtggctgcaa

SEQ ID NO: 555702 - DNA, 418 bp, Homo sapiens
  misc_feature: HIJSMM301DQJGL.18.78.H01.1.454.light.4.raw
tacgagtatgcacgaccggtgctcgatttagtgtgagtagtttgggtttggggctttgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaaccccactgtcactctgttcccaccctcctccatactcgta

SEQ ID NO: 555703 - DNA, 504 bp, Homo sapiens; identical to SEQ ID NO: 538940
  misc_feature: HIJSMM301BC6MB.2.35.D02.1.454.light.4.raw

SEQ ID NO: 555704 - DNA, 479 bp, Homo sapiens
  misc_feature: HIJSMM301CMR53.10.23.C01.1.454.light.4.raw
catagtagtgcacgaccggtgctcgatttagtacacgtgattagggattggggtccaaacagagcttcagcaagcatagtgggaatctgcaccatgccctgggctctgctcctcctgaccctcctcactcactctgcagtgtcagtggtccaggcaggactgactcagccaccctcggtgtccaagggcttgagacagaccgccacactcacctgcactgggaacaccaacaatgtcggcaacgaaggagcagcttggctgcagcagcaccagggccaccctcccaaactcctatcctacaggaataacaaccggccctcagggatctcagagagattctcttcattcaggtcaggaaacacagcctccctgaccattactggactccagcctgaggacgaggctgactattactgctcagcatgggacatcagcctcagtggttgggtgttcggcggagggaccaagctgactgtcct

SEQ ID NO: 555705 - DNA, 486 bp, Homo sapiens; identical to SEQ ID NO: 537617
  misc_feature: HIJSMM301CFZ1D.10.53.E09.1.454.light.4.raw

SEQ ID NO: 555706 - DNA, 441 bp, Homo sapiens; identical to SEQ ID NO: 534971
  misc_feature: HIJSMM301B49TC.11.3.A03.1.454.light.4.raw

SEQ ID NO: 555707 - DNA, 477 bp, Homo sapiens; identical to SEQ ID NO: 554966
  misc_feature: HIJSMM301A8JF4.12.1.A01.1.454.light.4.raw

SEQ ID NO: 555708 - DNA, 505 bp, Homo sapiens; identical to SEQ ID NO: 535503
  misc_feature: HIJSMM301C06LW.8.28.C06.1.454.light.4.raw

SEQ ID NO: 555709 - DNA, 488 bp, Homo sapiens
  misc_feature: HIJSMM301B0D7B.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccgaagctggagatcaaacgaaactgtggctgcaccat

SEQ ID NO: 555710 - DNA, 493 bp, Homo sapiens
  misc_feature: HIJSMM301BJ41K.27.78.H01.1.454.light.4.raw
agcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccgtcggccaagggacacgactggagattaaacgaactgtggctgcaccatctgt

SEQ ID NO: 555711 - DNA, 501 bp, Homo sapiens; identical to SEQ ID NO: 542394
  misc_feature: HIJSMM301CGPWL.18.23.C01.1.454.light.4.raw

SEQ ID NO: 555712 - DNA, 488 bp, Homo sapiens
  misc_feature: HIJSMM301DJRCL.19.57.F02.1.454.light.4.raw
tactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtccctcaaggttcagcggcagtggatctgggacagatttcactctcgccatcagcagcctgcagactgaagattttgcaacttattttgtcaacaggctaacactttccccctcactttcggcggaggaccaaggtggagatcaagcgaactgtggctgcaccatctgtctt

SEQ ID NO: 555713 - DNA, 514 bp, Homo sapiens
  misc_feature: HIJSMM301B7ZT5.15.86.H09.1.454.light.4.raw
  modified_base (400)..(400): a, c, t, g, unknown or other
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccaanacaattgatggccaagacggttgggtgttcggcggagggaccaagctgaccgtcctaggtcagcccaaggctgccccctcggtcactctgttcccaccctcctcgctacgtaga

SEQ ID NO: 555714 - DNA, 507 bp, Homo sapiens
  misc_feature: HIJSMM301EFSBU.40.67.G01.1.454.light.4.raw
tctagcgactcacgaccggtgctcgatttagagtatacatattgggtttggggagagccctggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccagggccactggcgtcccggccaggttcagtggcagtgggtctgggacagccttcactctcaccatcagcagcctggagcccgaagattttgcggtttattactgtcagcagcgtgccgactggcccctcacgttcggcggagggaccaaggtggacatcaaacgaactgtggctgcaccatctgtcttcat

SEQ ID NO: 555715 - DNA, 481 bp, Homo sapiens
  misc_feature: HIJSMM301BIGHX.13.55.E11.1.454.light.4.raw
tcacgtactacacgaccggtgctcgatttagcactcgcacgttgggtttggggactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaagtggggtcccatcaaggttcagcggcagtggatctggcacagacttcattctcaccatcagcagcctgcagcctgaagattttgcaacttattactgtctacaagatcacaattatcctgggacttcggccaagggaccaaggtggaaatcaaacgaactgtggctgcaccatctgtcttcta

SEQ ID NO: 555716 - DNA, 503 bp, Homo sapiens
  misc_feature: HIJSMM301AXUAF.5.86.H09.1.454.light.4.raw
atcagacacgcacgaccggtgctcgatttagtgctatagacttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccatactgaggatgaggctgactattactgcagctcatttgcaggcagccgtatactcttcggcggagggaccaagctgaccgtcctaggtcagcccaaggctgccccctcggtca

SEQ ID NO: 555717 - DNA, 494 bp, Homo sapiens; identical to SEQ ID NO: 534992
  misc_feature: HIJSMM301D10H7.9.1.A01.1.454.light.4.raw

SEQ ID NO: 555718 - DNA, 517 bp, Homo sapiens; identical to SEQ ID NO: 548112
  misc_feature: HIJSMM301C8Y4G.3.87.H10.1.454.light.4.raw

SEQ ID NO: 555719 - DNA, 514 bp, Homo sapiens; identical to SEQ ID NO: 549007
  misc_feature: HIJSMM301AN65U.22.30.C08.1.454.light.4.raw

SEQ ID NO: 555720 - DNA, 521 bp, Homo sapiens; identical to SEQ ID NO: 538715
  misc_feature: HIJSMM301A5SFL.27.23.C01.1.454.light.4.raw

SEQ ID NO: 555721 - DNA, 486 bp, Homo sapiens; identical to SEQ ID NO: 535043
  misc_feature: HIJSMM301AO86Q.46.35.D02.1.454.light.4.raw

SEQ ID NO: 555722 - DNA, 454 bp, Homo sapiens; identical to SEQ ID NO: 536347
  misc_feature: HIJSMM301A62RK.19.86.H09.1.454.light.4.raw

SEQ ID NO: 555723 - DNA, 447 bp, Homo sapiens; identical to SEQ ID NO: 535201
  misc_feature: HIJSMM301D10IK.18.9.A09.1.454.light.4.raw

SEQ ID NO: 555724 - DNA, 496 bp, Homo sapiens; identical to SEQ ID NO: 536802
  misc_feature: HIJSMM301CJQEL.5.24.C02.1.454.light.4.raw

SEQ ID NO: 555725 - DNA, 484 bp, Homo sapiens; identical to SEQ ID NO: 536162
  misc_feature: HIJSMM301AIV6O.13.59.F04.1.454.light.4.raw

SEQ ID NO: 555726 - DNA, 494 bp, Homo sapiens; identical to SEQ ID NO: 535629
  misc_feature: HIJSMM301BADI4.4.27.C05.1.454.light.4.raw

SEQ ID NO: 555727 - DNA, 481 bp, Homo sapiens; identical to SEQ ID NO: 537385
  misc_feature: HIJSMM301C0RT1.52.4.A04.1.454.light.4.raw

SEQ ID NO: 555728 - DNA, 506 bp, Homo sapiens
  misc_feature: HIJSMM301DZA3R.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggtcgctcactttcggcggagggaccaaggtggagatcaaacgaactgtggctgcaccatctgtt

SEQ ID NO: 555729 - DNA, 444 bp, Homo sapiens; identical to SEQ ID NO: 535192
  misc_feature: HIJSMM301AHIHD.5.9.A09.1.454.light.4.raw

SEQ ID NO: 555730 - DNA, 492 bp, Homo sapiens; identical to SEQ ID NO: 536010
  misc_feature: HIJSMM301BRCKB.10.20.B09.1.454.light.4.raw

SEQ ID NO: 555731 - DNA, 498 bp, Homo sapiens; identical to SEQ ID NO: 544540
  misc_feature: HIJSMM301CYPCV.41.20.B09.1.454.light.4.raw

SEQ ID NO: 555732 - DNA, 499 bp, Homo sapiens; identical to SEQ ID NO: 536209
  misc_feature: HIJSMM301DJXTZ.26.26.C04.1.454.light.4.raw

SEQ ID NO: 555733 - DNA, 484 bp, Homo sapiens; identical to SEQ ID NO: 550726
  misc_feature: HIJSMM301EMN4R.47.62.F07.1.454.light.4.raw

SEQ ID NO: 555734 - DNA, 493 bp, Homo sapiens; identical to SEQ ID NO: 535084
  misc_feature: HIJSMM301EIQV0.47.64.F09.1.454.light.4.raw

SEQ ID NO: 555735 - DNA, 443 bp, Homo sapiens
  misc_feature: HIJSMM301AU5HA.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggacgaggctgattattactgcagctcatatacaagcaccagcactctctatgtcttcggaactgggaccaaggtcaccgtcctaggtcagcccaaggccaacccactgtcactctgttcccgccctcctccatactcgta

SEQ ID NO: 555736 - DNA, 520 bp, Homo sapiens
  misc_feature: HIJSMM301BY2OA.5.27.C05.1.454.light.4.raw
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctcgttcccaccctcctccgtgt

SEQ ID NO: 555737 - DNA, 499 bp, Homo sapiens
  misc_feature: HIJSMM301DVHNW.11.59.F04.1.454.light.4.raw
cgagagataccacgaccggtgctcgatttagtacacacacttagggattggggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagcccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctactcttttctcttcggaactgggaccacggtcaccgtcctaggtcagcccaaggccaaccccactgtcactctgttcccaccctcctcgtatctctcg

SEQ ID NO: 555738 - DNA, 492 bp, Homo sapiens; identical to SEQ ID NO: 551336
  misc_feature: HIJSMM301DUGUD.5.48.E04.1.454.light.4.raw

SEQ ID NO: 555739 - DNA, 485 bp, Homo sapiens; identical to SEQ ID NO: 545589
  misc_feature: HIJSMM301DKP2A.26.70.G04.1.454.light.4.raw

SEQ ID NO: 555740 - DNA, 518 bp, Homo sapiens
  misc_feature: HIJSMM301DEX24.41.19.B08.1.454.light.4.raw
tctatactatcacgaccggtgctcgatttagtgagtcagtaagggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgctttataattttgtcgcctggtaccaacaacacccggcgaagccccagactcataatttatgatgtcactgatcggccctcagggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaaccccactgtcactctgttcccgccctcct

SEQ ID NO: 555741 - DNA, 497 bp, Homo sapiens
  misc_feature: HIJSMM301DGQDF.27.78.H01.1.454.light.4.raw
agcgtcgtctcacgaccggtgctcgatttagtgtgagtagtttgggtttggggatgagcaaaactgacaagtcaaggcaggaagatgttgccatcaaaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaactgtggctgcaccatctgtcttcta

SEQ ID NO: 555742 - DNA, 514 bp, Homo sapiens
  misc_feature: HIJSMM301EKAYT.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactcactattggtacttcgggaacctaggggaccaacggtccaccggtcctaggtcccaaggcccaaaccgg

SEQ ID NO: 555743 - DNA, 487 bp, Homo sapiens
  misc_feature: HIJSMM301C7D9H.7.85.H08.1.454.light.4.raw
cgtgtctctacacgaccggtgctcgatttagtatcactcagtcgcggggtccaaacagagcttcagcaaacatagtgggaatctgcaccatgccctgggctctgctcctcctgaccctcctcactcactctgcagtgtcagtggtccaggcagggctgactcagccaccctcggtgtccaagggcctgcgacagaccgcaacactcacctgcactgggagcagcaacgatgttggcagggagggagcagcttggctgcagcaacacgagggccaccctcccaaactcctctcctacaggaataacgagcggccctcagggatctcagagagattctctgcatccaggtcaggaaacacagcctcctgaccattactggactccagcctgaggacgaggctgactattactgctcagcatgggacagcggcctcaggacttatgtcttcggaactgggacccacgttaccgtcctaggtcagaccccg

SEQ ID NO: 555744 - DNA, 505 bp, Homo sapiens
  misc_feature: HIJSMM301E2MNU.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaagtggatatcaaacgaactagtggctgcaccatctgtt

SEQ ID NO: 555745 - DNA, 471 bp, Homo sapiens
  misc_feature: HIJSMM301BW6C5.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctcaacgtgatgatgttgcaacatactattgtcagcaatatgattttgctcctccgagtgccacttttggcggggggaccaaggtggacatcaaacgaa

SEQ ID NO: 555746 - DNA, 511 bp, Homo sapiens
  misc_feature: HIJSMM301DB8T1.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccgcctcct

SEQ ID NO: 555747 - DNA, 495 bp, Homo sapiens
  misc_feature: HIJSMM301BUK2B.43.10.A10.1.454.light.4.raw
tgtgagtagtcacgaccggtgctcgatttagcgtcgatctcaggggagctgtgggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcaaatactattatgccagctggtaccagcagaaaccaagacaggcccctatacttgtcatctatggtaaaaacaaccgaccctcagggatcccagaccgattctctggctccagctcaggcaacacagcttccttgaccatcactggggctcaggcggaagatgaggctgactattactgtaactcccgggacagcaatggtgacctatatgtcttcggaactgggaccaaggtcaccgtcctaggtcagcccaaggccaaccccactgtca

SEQ ID NO: 555748 - DNA, 486 bp, Homo sapiens; identical to SEQ ID NO: 535043
  misc_feature: HIJSMM301CDN8T.46.35.D02.1.454.light.4.raw

SEQ ID NO: 555749 - DNA, 493 bp, Homo sapiens
  misc_feature: HIJSMM301APPBT.41.67.G01.1.454.light.4.raw
tctatactatcacgaccggtgctcgatttagagtatacatattgggtttgggggagctctggggagtctgcaccatggcttggaccccactcctcttcctcaccctcctcctccactgcacagggtctctctcccagcttgtgctgactcaatcgccctctgcctctgcctccctgggaacctcggtcaagctcacctgcactctgagcagtggagacagcagacacgccatcgcatggcatcagcagcagccaggaaggggccctcgattcctgatgaaacttacttttgatggcagccacaccaagggggacgggatccctgatcgcttctcaggctccagctctggggctgagcgctacctttcgatctccagcctccagtctgaggatgaggctgactattactgtcagtcctgggacaggggcgttttggtgttcggcggagggaccagactgaccgtcctgggtcagcccaaggctgccccctcggt

SEQ ID NO: 555750 - DNA, 483 bp, Homo sapiens
  misc_feature: HIJSMM301DWZXK.41.78.H01.1.454.light.4.raw
tctatactatcacgaccggtgctcgatttagtgtgagtagtttgggtttgggggatcaggacttctcagttcatcttctcaccatgaggctccctgctcagctcctggggctgctaatgctctggatacctggatccagtgcagatattgtgatgtcccagactccactctctctgtccgtcacccctggacagccggcctccatctcctgcaagtctagtcagagtctcctccatgagaatggcaaaacttatttctactggtacctacagaaggcaggccagccgccacagctcctgatctatgaggttttcaggcggttctctggagtgccagacaggttcagtggcagcgggtccgggacagatttcacactgaggatcagtcgggtggaggctgacgacgttgggacttattactgcgcgcaaagtctacaccttcctctcactttgggccctgggaccaaagtggacatcaaacgaa

SEQ ID NO: 555751 - DNA, 489 bp, Homo sapiens; identical to SEQ ID NO: 536663
  misc_feature: HIJSMM301B3FY7.16.72.G06.1.454.light.4.raw

SEQ ID NO: 555752 - DNA, 504 bp, Homo sapiens; identical to SEQ ID NO: 547306
  misc_feature: HIJSMM301EZNIN.10.71.G05.1.454.light.4.raw

SEQ ID NO: 555753 - DNA, 494 bp, Homo sapiens; identical to SEQ ID NO: 534992
  misc_feature: HIJSMM301EQWIS.9.1.A01.1.454.light.4.raw

SEQ ID NO: 555754 - DNA, 512 bp, Homo sapiens
  misc_feature: HIJSMM301DX3LP.10.80.H03.1.454.light.4.raw
catagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctgtgggggagacagcattgaaagtgaagctgtccactggtaccagcagaggccaggccaggcccctgtactggtcctctatgatgatagtgaccggccctcagggatccctgagcgattctctggctccaactctgggaacacggccaccctgaccatcaccagggtcgaagccggggatgaggccgactattattgtcaggtgtggtatttcagtagtattcatccgggggttttcggcggagggaccaagctgaccgtcctaggtcagcccaaggctgccccctggtcactctgttccca

SEQ ID NO: 555755 - DNA, 512 bp, Homo sapiens; identical to SEQ ID NO: 541300
  misc_feature: HIJSMM301D5M9X.17.33.C11.1.454.light.4.raw

SEQ ID NO: 555756 - DNA, 444 bp, Homo sapiens
  misc_feature: HIJSMM301CTSP7.9.9.A09.1.454.light.4.raw
tgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaacccctcatctatggtaatagtaatcggccctcaggggtccctgaccgattctctggctccaagtctggtacctcagcctccctggccatcactgggcttcaggctgaggatgaggctgattattactgccactcctatgacagcagcctgagaagtgtggtattcggcggagggaccaagctgaccgtcctaggtcagcccaaggctgccccctcggtcactctgttcccaccctcctcagacgtatca

SEQ ID NO: 555757 - DNA, 496 bp, Homo sapiens
  misc_feature: HIJSMM301EY0EF.49.15.B04.1.454.light.4.raw
agtcgagagacacgaccggtgctcgatttagacagtatatatccgcgggcacgaccggtgctcgatttagagtgagctcgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttaggagcaacttagcctggtatcagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataatgtccgggctccggacactttcggcggagggaccaa

SEQ ID NO: 555758 - DNA, 464 bp, Homo sapiens
  misc_feature: HIJSMM301EPZ40.49.73.G07.1.454.light.4.raw
agtcgagagacacgaccggtgctcgatttagctctacgctcagggggagtcagtcccaaccaggacacagcatggacatgagggtccctgctcagctcctggggctcctgctgctctggctctcaggtgccagatgtatcatccagatgacccagtctccttcctccctgtctgcatctataggagacagaatcaccatcacttgccgggcgagtcgagacattagcatgtatctgaattggtatcagcaaaaaccagggacagcccctaaactcctgatcctcgatgcatccactttggagacaggggtcccatcaaggttcagtggaagtggctctgggacagattttactttcaccatcagcaggctgcagcctgaagatattgcaacatattactgtcaacagtatgatcgcctcccgctcactttcggcggggggaccgaaggtggagagtcaagcgaa

SEQ ID NO: 555759 - DNA, 507 bp, Homo sapiens
  misc_feature: HIJSMM301AY02P.11.75.G09.1.454.light.4.raw
cgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccggttatggtatgctctggtatcaacaacgtccaggaatggcccccaaactcctcatctatgctgacaacaatcgaccttcagggtccctcgaccggttctctggctccaagtctggctcttccgcctccttggccatcactgggctcgaggctgacgatgaggctgattactactgtctgtcctatgacgacgacctacagactccggttttcggcggagggactaagctgaccgtcctaagtcagcccaaggctgccccctcggtcactctgttcccta

SEQ ID NO: 555760 - DNA, 489 bp, Homo sapiens
  misc_feature: HIJSMM301D5BHP.40.77.G11.1.454.light.4.raw
tctagcgactcacgaccggtgctcgatttagctagtcactcaagggaaagggggagtcagacccagtcaggacacagcatggacatgagggtccccgctcagctcctggggctcctgctgctctggctcccaggtgccaaatgtgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagctttgatgattttgcaacttatttctgccaacagtatcatacttattctcggaccttcggccaaggaccaggtggaaatcaaacgaactagtggctgcaccatctgtt

SEQ ID NO: 555761 - DNA, 494 bp, Homo sapiens
  misc_feature: HIJSMM301DIMAR.48.1.A01.1.454.light.4.raw
agtatacatacacgaccggtgctcgatttagacgtctcatcagggggcaggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaattttcgctgtctccagtttgcagagtggagtcccatctcggttcagcggcagtggatctggggcagagttcattctcaccatcaacagccttcagcctgaagattttgcaacttactattgtcagcagggtgacagtttccctcccactttcggcggagggaccagggtggacgtcaaacgaactgtggctgcaccatctgtcttcattcc

SEQ ID NO: 555762 - DNA, 495 bp, Homo sapiens; identical to SEQ ID NO: 538651
  misc_feature: HIJSMM301BUS06.10.79.H02.1.454.light.4.raw

SEQ ID NO: 555763 - DNA, 491 bp, Homo sapiens
  misc_feature: HIJSMM301CZ3JH.40.87.H10.1.454.light.4.raw
tctagcgactcacgaccggtgctcgatttagcagtactgcgttgggtttggggtggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttatttttgctgctcttatgcaggcagtttcgctctcgaagtgttcggcggagggaccgagctgaccgtcctacgtcagccc

SEQ ID NO: 555764 - DNA, 504 bp, Homo sapiens; identical to SEQ ID NO: 535561
  misc_feature: HIJSMM301EKGPI.4.57.F02.1.454.light.4.raw

SEQ ID NO: 555765 - DNA, 513 bp, Homo sapiens
  misc_feature: HIJSMM301DE85A.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaacggcccccaaactcctcatctataggaataatcagcggccctcaggggtccctgaccgattctctggctccaaggctggcacctcagcctccctggccatcagtgggctccggtccgaggatgaggctgattattactgtgcagcatgggatgacagcctgagtggtccttgggtgttcggcggaggaccaagctgaccgtcctaagtcagcccaaggctgccccctcggtcactctgttcccaccctctcg

SEQ ID NO: 555766 - DNA, 505 bp, Homo sapiens
  misc_feature: HIJSMM301AJKCJ.49.48.E04.1.454.light.4.raw
agtcgagagacacgaccggtgctcgatttagagagcgtcacagagagaagggggtgggctcaggaggcagagctctgggaatctcaccatggcctggacccctctcctgctccccctcctcactttctgcacagccccctctcttgttttccttgcagtctctgaggcctcctatgagctgacacagccaccctcggtgtcagtgtccccaggacaaacggccaggatcacctgctctggagatgcattgccaaaaaatatgcttattggtaccagcagaagtcaggccaggcccctgtactggtcatctacgaggacagtaaacgaccctccgggatccctgcgagattctctgcctctagttcagggacaatggccaccttgactatcagtggggcccaggtgaggatgaagctgactactattgttactcaacagacagcagtgccgagggggtcttcggcggaggaccaagctgaccgtcctaggtcagcccaaggctccg

SEQ ID NO: 555767 - DNA, 483 bp, Homo sapiens; identical to SEQ ID NO: 535413
  misc_feature: HIJSMM301DV5FX.26.78.H01.1.454.light.4.raw

SEQ ID NO: 555768 - DNA, 493 bp, Homo sapiens
  misc_feature: HIJSMM301BJNUV.16.6.A06.1.454.light.4.raw
tgtactactccacgaccggtgctcgatttagatctactgacagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagcttggtaccagcagaaaccggggcagtctcctaagttgctcatttactgggcgtctacccgggaatccggggtccctgaccgattcagtggcagcgggtctgggacagatttcactctcaccatcagcagcctgcaggttgaagatgtggcagtttattactgtcagcagtattatactactcctctgacgttcggccaagggaccaaggtggagatcaaacaactgtggctgcaccat

SEQ ID NO: 555769 - DNA, 523 bp, Homo sapiens
  misc_feature: HIJSMM301CKZB6.12.53.E09.1.454.light.4.raw
  modified_base (518)..(518): a, c, t, g, unknown or other
atacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctatttcggcggagggaccgaacgctcgaccgtcctcgggtcgagcccaacggctgccccctccggtccaccttctcgttcccacccctcctcctacgtcgtntctga

SEQ ID NO: 555770 - DNA, 517 bp, Homo sapiens
  misc_feature: HIJSMM301AHEMA.27.23.C01.1.454.light.4.raw
agcgtcgtctcacgaccggtgctcgatttagtacacgtgattagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttccc

SEQ ID NO: 555771 - DNA, 497 bp, Homo sapiens
  misc_feature: HIJSMM301EDVEN.15.83.H06.1.454.light.4.raw
tctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaaattggtatcagcagaaaccagggaaagcccctaagctcctgatctatggtgcatccagtttgcaaagtggggccccatcaaggttcagtggcagtggctctgggacagatttcactctcaccatcagcagtctccaacctgaagattttgcaacttactactgtcaacagagttttcagtagtccccggacgttcggccaaggaccaacggtaggacgatcaaacgaacctagtggctgcaccatctgtcttt

SEQ ID NO: 555772 - DNA, 490 bp, Homo sapiens; identical to SEQ ID NO: 535234
  misc_feature: HIJSMM301EPWLV.17.21.B10.1.454.light.4.raw

SEQ ID NO: 555773 - DNA, 490 bp, Homo sapiens; identical to SEQ ID NO: 534991
  misc_feature: HIJSMM301EJXJ8.48.75.G09.1.454.light.4.raw

SEQ ID NO: 555774 - DNA, 498 bp, Homo sapiens
  misc_feature: HIJSMM301C76MI.40.17.B06.1.454.light.4.raw
tctagcgactcacgaccggtgctcgatttagtcgatagtgaagggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgccgggccagtcagagtattagtacctggttggcctggtatcagcagaaaccagggaaagcccctaagttcctgatctataaggcgtctagtttagaaagtggggtcccatcaaggatcagcggcagtggatctgggacagaattcactctcaccattagtagcctgcagcctgatgattttgcaacttattactgccaacaatataatgattttccgtggacgttcggccaaggaccaaggtagaaatcaaacgaactagtggctgcaccatctgtcttcatcttcccgccta

SEQ ID NO: 555775 - DNA, 508 bp, Homo sapiens; identical to SEQ ID NO: 535649
  misc_feature: HIJSMM301BG42D.47.55.E11.1.454.light.4.raw

SEQ ID NO: 555776 - DNA, 508 bp, Homo sapiens; identical to SEQ ID NO: 555268
  misc_feature: HIJSMM301A8B51.40.12.B01.1.454.light.4.raw

SEQ ID NO: 555777 - DNA, 497 bp, Homo sapiens; identical to SEQ ID NO: 545672
  misc_feature: HIJSMM301A6P3R.2.49.E05.1.454.light.4.raw

SEQ ID NO: 555778 - DNA, 502 bp, Homo sapiens
  misc_feature: HIJSMM301CN81B.48.3.A03.1.454.light.4.raw
agtatacatacacgaccggtgctcgatttagagagcgtcacgatctctcttgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgaccatctctgggctccaggctgaagatcaggctgattattactgctgttcattttcaagttcctttttgtcttcggaactgggaccgaggtcacgtcctaggtcagcccaaggccaacccactgtcta

SEQ ID NO: 555779 - DNA, 502 bp, Homo sapiens; identical to SEQ ID NO: 544940
  misc_feature: HIJSMM301C5KZN.9.53.E09.1.454.light.4.raw

SEQ ID NO: 555780 - DNA, 494 bp, Homo sapiens; identical to SEQ ID NO: 534994
  misc_feature: HIJSMM301BQPP3.27.78.H01.1.454.light.4.raw

SEQ ID NO: 555781 - DNA, 486 bp, Homo sapiens; identical to SEQ ID NO: 535043
  misc_feature: HIJSMM301BSELY.46.35.D02.1.454.light.4.raw

SEQ ID NO: 555782 - DNA, 447 bp, Homo sapiens; identical to SEQ ID NO: 535020
  misc_feature: HIJSMM301B4Y5X.18.9.A09.1.454.light.4.raw

SEQ ID NO: 555783 - DNA, 422 bp, Homo sapiens; identical to SEQ ID NO: 447881
  misc_feature: HIJSMM301A1I47.9.34.D01.1.454.light.4.raw

SEQ ID NO: 555784 - DNA, 481 bp, Homo sapiens; identical to SEQ ID NO: 535993
  misc_feature: HIJSMM301A3QVS.21.25.C03.1.454.light.4.raw

SEQ ID NO: 555785 - DNA, 498 bp, Homo sapiens
  misc_feature: HIJSMM301DYDU7.26.80.H03.1.454.light.4.raw
agactatactcacgaccggtgctcgatttagctgtgcgtcgaagggaaagggactgactaccacctgcaggtcagggccaaggttatggggtcccaggttcacctcctcagcttcctcctcctttggatctctgagccgacactcacgcagtctccagcattcatgtcagcgactctaggagacaaggtcaacttctcctccaaagccagccaagacattgatgatgatatgaactggcaccaacacaaaccaggagaagctgctatttccattactcaagaaactaatggtctcctacctggaatgccacctcgactcagtggcaacaaatatggaacagtttttaccctcacaactcatatcacagaatctgaggatgctgcatttttacttcggtctacaacatgataatttccctccgtggacgttcggccaagggaccaaggagcaaatcaaacgaactgtggctgcaccatctgtcttcatcttcccgccat

SEQ ID NO: 555786 - DNA, 494 bp, Homo sapiens
  misc_feature: HIJSMM301EI91X.10.79.H02.1.454.light.4.raw
catagtagtgcacgaccggtgctcgatttagtgtcacacgaagggaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggccaggggaccaagctggagatcaaacgaactgtggctgcacatctgtctt

SEQ ID NO: 555787 - DNA, 486 bp, Homo sapiens; identical to SEQ ID NO: 535043
  misc_feature: HIJSMM301BTRGM.46.35.D02.1.454.light.4.raw

SEQ ID NO: 555788 - DNA, 511 bp, Homo sapiens
  misc_feature: HIJSMM301CNA15.19.59.F04.1.454.light.4.raw
tactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggaagaattttgtgtcctggtaccagcagctcccaggaacagcccccaaactcctcatttttgacaataataagcgaccctcagggattcctgaccgattctctggctccaagtctggcacgtcagccaccctgggcatcaccggactccagactggggacgaggccgattattactgcggaacatgggatagcagcctgagtactgtgataatcggcggagggaccaagctgaccgtcctaggtcagcacaaggctgccccctcggtcactctgttccccg

SEQ ID NO: 555789 - DNA, 509 bp, Homo sapiens
  misc_feature: HIJSMM301AMSRU.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaagctgaccgtcctaggtcacgccaaggctcgtccccccg

SEQ ID NO: 555790 - DNA, 440 bp, Homo sapiens; identical to SEQ ID NO: 539180
  misc_feature: HIJSMM301B3AA9.11.3.A03.1.454.light.4.raw

SEQ ID NO: 555791 - DNA, 492 bp, Homo sapiens
  misc_feature: HIJSMM301E378R.5.47.E03.1.454.light.4.raw
atcagacacgcacgaccggtgctcgatttagactcgcgcacagagagaagggggaagagctgctcagttaggacccagagggaaccatggaaaccccagcgcagcatctcttcctcctgctactctggctcccagataccgccggagaaattgtgttgacgcagtctccaggcaccctgtctttgtctccaggagaaagagccaccctctcctgcagggccagtcagagtgttagcggcgactacttagcctggtaccagcagaaacctggccagactcccaggctcctcatctttggtgtatccagcagggccactggcatcccacgtaggttcagtggcagtgggtctgggacagacttcactctcaccatcagcagactggagcctgaagattttgcagtgtattactgtcagcagtatgggctctcacctttcactttcggtcggagggaccgaaggtggagaacaaacgaactagtggctgcaccat

SEQ ID NO: 555792 - DNA, 505 bp, Homo sapiens
  misc_feature: HIJSMM301DM7AU.5.24.C02.1.454.light.4.raw
atcagacacgcacgaccggtgctcgatttagtacagatcgttaggggaaagggggggtcgtcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcgggggaccaagctgaccgtcctaggtcagccaaggctgcccccg

SEQ ID NO: 555793 - DNA, 445 bp, Homo sapiens; identical to SEQ ID NO: 537719
  misc_feature: HIJSMM301CLGVC.47.85.H08.1.454.light.4.raw

SEQ ID NO: 555794 - DNA, 517 bp, Homo sapiens
  misc_feature: HIJSMM301CTHC7.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtgggcaggtcagcccaaggccaacccactcgtcactctcg

SEQ ID NO: 555795 - DNA, 385 bp, Homo sapiens
  misc_feature: HIJSMM301AKF11.48.52.E08.1.454.light.4.raw
agtatacatacacgaccggtgctcgatttagtcgagctctcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcacca

SEQ ID NO: 555796 - DNA, 505 bp, Homo sapiens
  misc_feature: HIJSMM301AV73N.17.28.C06.1.454.light.4.raw
cgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacattttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggaggggaccaggctgaccgtcctaagtcagcccaaggctg

SEQ ID NO: 555797 - DNA, 495 bp, Homo sapiens; identical to SEQ ID NO: 535596
  misc_feature: HIJSMM301D4QLW.10.79.H02.1.454.light.4.raw

SEQ ID NO: 555798 - DNA, 502 bp, Homo sapiens
  misc_feature: HIJSMM301DTC2A.13.59.F04.1.454.light.4.raw
tcacgtactacacgaccggtgctcgatttagtacacacacttagggattgggggcagaagtctctctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgtcgtccaggaccaaggtggaagtacaagcgaactagtggcgtgcgaccactctgtcttctatt

SEQ ID NO: 555799 - DNA, 495 bp, Homo sapiens
  misc_feature: HIJSMM301COW1W.49.22.B11.1.454.light.4.raw
agtcgagagacacgaccggtgctcgatttagacgacagctcagggcacgaccggtgctcgatttagacgacagctcagggggaggaactgctcagttaggacccagagggaaccatggaagccccagctcagcttctcttcctcctgctactctggctcccagatatttccgaagaaattgtgttgacacagtctccagccaccctctatctgtctccaggggaaagagccaccctctcctgcagggccagtcagagtgttaacaacttcttaggctggtatcaacaaaaacctggccaggttcccaggctcctcgtctatgatgcgtccatcagggccactggcatcccagccaggttcagtggcagtgggtctgggacagacttcactctcaccatcagcagcctagagcctgaagactttgcagtttattactgtcagcagcgtagcaatttgatcaccttcggccaagggacacgactggaaattaacgaa

SEQ ID NO: 555800 - DNA, 498 bp, Homo sapiens
  misc_feature: HIJSMM301CZEAA.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccaaggaccaaggtggaatacaaacgaactagtggctgcacc

SEQ ID NO: 555801 - DNA, 509 bp, Homo sapiens
  misc_feature: HIJSMM301DFV3C.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctgggaccgaaggtggagatcaaacgaactgtggctgcaccatctgtcttcta

SEQ ID NO: 555802 - DNA, 512 bp, Homo sapiens
  misc_feature: HIJSMM301E0GVH.43.34.D01.1.454.light.4.raw
  modified_base (431)..(431): a, c, t, g, unknown or other
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaacgcccccaaactcatgatttatgagggcactaagcggccctcaggggtttctgatcgcttctctggctccaagtctggcaacacggcctccctgacaatctctgggctccaggctgaggacgaggctgattattattgctgctcattttangcaggttagttactacttatgttcttcggaagttgggacgacggtccaccgtcctaggtcacgcccgaacggcccaacccc

SEQ ID NO: 555803 - DNA, 480 bp, Homo sapiens
  misc_feature: HIJSMM301D9ND6.11.11.A11.1.454.light.4.raw
cgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctcctaaactgctcatctcctgggcatctacccgggcacccggagtccctgaccgattcagtggcagcgggtctgggacagacttcactctcaccatcagcaacctgcaggctgaagatgtggcagtttattactgtcagcagtattgtgaagctccgctcactttcggtcggagggaccggcgtggagatcagacgaactgtggctgcaccatctgtcttt

SEQ ID NO: 555804 - DNA, 506 bp, Homo sapiens
  misc_feature: HIJSMM301A71QI.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctggaccaaagtggatatcaaacgaactagtggcgtgcaccatctgtctt

SEQ ID NO: 555805 - DNA, 484 bp, Homo sapiens; identical to SEQ ID NO: 537086
  misc_feature: HIJSMM301A606N.5.39.D06.1.454.light.4.raw

SEQ ID NO: 555806 - DNA, 480 bp, Homo sapiens
  misc_feature: HIJSMM301EALKW.7.76.G10.1.454.light.4.raw
cgtgtctctacacgaccggtgctcgatttagtcactcatacagggggcaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagcccctaaactcctgatctctgctgcatccagtttacaaagtggggtcccatcgcggttcagcggcagtggatatgggacatatttcactctcgccatcagcagcctgcagcctgaagattttgcaacttactattgtcaacaggctaacagtttcccgctcaccttcggcgggggaccgaaggtggagatcaaacgaactagtggctgcacc

SEQ ID NO: 555807 - DNA, 494 bp, Homo sapiens; identical to SEQ ID NO: 534994
  misc_feature: HIJSMM301CVDN5.27.78.H01.1.454.light.4.raw

SEQ ID NO: 555808 - DNA, 468 bp, Homo sapiens
  misc_feature: HIJSMM301D2FMS.3.68.G02.1.454.light.4.raw
agacgcactccacgaccggtgctcgatttagtcgatagtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagtgttagcagctatttaaattggtatcagcagaaaccagggaaagcccctaagctcctgatctatgctgcatccactttgcatggtggggtcccatcaagcttcagtggcagtggatctgggacagatttcactctcaccatcagcaatctgcaacctgaagattttgcaacttactactgtcaacagagttacagtacccctccgacttttggccaggggaccaagctggagatcaaacgaa

SEQ ID NO: 555809 - DNA, 500 bp, Homo sapiens
  misc_feature: HIJSMM301CNNID.43.87.H10.1.454.light.4.raw
tgtgagtagtcacgaccggtgctcgatttagcagtactgcgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgatttattattgctgctcatatgcaggtagttacacttatgtcttcggaattgggacacggtcaccgtcctaggtcagcccaaggccaacccca

SEQ ID NO: 555810 - DNA, 476 bp, Homo sapiens; identical to SEQ ID NO: 538611
  misc_feature: HIJSMM301BU1QO.7.81.H04.1.454.light.4.raw

SEQ ID NO: 555811 - DNA, 499 bp, Homo sapiens; identical to SEQ ID NO: 543887
  misc_feature: HIJSMM301D83WY.10.65.F10.1.454.light.4.raw

SEQ ID NO: 555812 - DNA, 505 bp, Homo sapiens
  misc_feature: HIJSMM301B1TEE.9.53.E09.1.454.light.4.raw
tgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttggggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacatccccgtggtattcggcggagggaccaaggtgaccgtcctaggtcagcccaaggctgccccccg

SEQ ID NO: 555813 - DNA, 407 bp, Homo sapiens; identical to SEQ ID NO: 536776
  misc_feature: HIJSMM301A7INY.40.8.A08.1.454.light.4.raw

SEQ ID NO: 555814 - DNA, 462 bp, Homo sapiens; identical to SEQ ID NO: 542244
  misc_feature: HIJSMM301DO3IZ.49.73.G07.1.454.light.4.raw

SEQ ID NO: 555815 - DNA, 488 bp, Homo sapiens; identical to SEQ ID NO: 536554
  misc_feature: HIJSMM301AN0AZ.26.37.D04.1.454.light.4.raw

SEQ ID NO: 555816 - DNA, 484 bp, Homo sapiens
  misc_feature: HIJSMM301BY5SE.17.26.C04.1.454.light.4.raw
cgtagactagcacgaccggtgctcgatttagtctagcgactttgggtttggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtgggtcccttcaaggttcagtggcagtggatctgggacagatttcactctcaccatcagcagtctgcaacctgaagattttgcaacttactactgtcaacagagttacaataccctcggctcactttcggcggagggaccaaggtggagatcaaacgaactgtggctgcaccta

SEQ ID NO: 555817 - DNA, 447 bp, Homo sapiens; identical to SEQ ID NO: 535020
  misc_feature: HIJSMM301DVQRU.18.9.A09.1.454.light.4.raw

SEQ ID NO: 555818 - DNA, 493 bp, Homo sapiens; identical to SEQ ID NO: 536471
  misc_feature: HIJSMM301D66MX.3.71.G05.1.454.light.4.raw

SEQ ID NO: 555819 - DNA, 487 bp, Homo sapiens
  misc_feature: HIJSMM301CKASK.43.73.G07.1.454.light.4.raw
tgtgagtagtcacgaccggtgctcgatttagctctacgctcagggcacgaccggtgctcgatttagctctacgctcagggggagagactgaagaacccagcattgcagcagctccaccatggcctgggctcctctgctcctcaccctcctcagtctcctcacagggtccctctcccagcttgtgctgactcagccaccttctgcatcagcctccctgggagcctcggtcacactcacctgcaccctgagcagcggctacaatgaatataaggtggactggtaccaacagagaccaggggagtgcccccgatttgtgatgcgagtgggcccggatgggatggcgggatccgaagggggatgggcatccctgatcggttctcagtcttgggctcaggcctgactcggtccctgaccatcaacaacatccaggaagaggatgacagtgactactactgtgggacgaattatggcagtgggaatacctaca

SEQ ID NO: 555820 - DNA, 492 bp, Homo sapiens
  misc_feature: HIJSMM301DZZZT.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtcgcccccccgatcaccttcggccaagggacacgactggagattaaacgaactgtggctgcaccatctgtcttcatt

SEQ ID NO: 555821 - DNA, 448 bp, Homo sapiens; identical to SEQ ID NO: 554904
  misc_feature: HIJSMM301BF8WB.18.9.A09.1.454.light.4.raw

SEQ ID NO: 555822 - DNA, 502 bp, Homo sapiens
  misc_feature: HIJSMM301AYCAS.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcagcagcactctctatgtcttcggaactgggaccaaggtcaccgtcctaggtcagcccaaggccaaccca

SEQ ID NO: 555823 - DNA, 509 bp, Homo sapiens
  misc_feature: HIJSMM301CH7M6.49.65.F10.1.454.light.4.raw
agtcgagagacacgaccggtgctcgatttagctacgctctaaggggctagggcctaaggaagcagcactggtggtgcctcagccatggcctggaccgttctcctcctcggcctcctctctcactgcacagtctctgtgacctcctatgtgctgtctcagtcaccctcggtgtcagtggccccaggacagacggccaggattacctgtgggggagacaacattggaaataaaggtgtgcactggtaccagcagatgccaggccaggcccctgtcctggtcgtctttgatgatagcgaccggccctcagggatccctgagcgattctctggctccaactctggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtcactctcgttcccgccct

SEQ ID NO: 555824 - DNA, 484 bp, Homo sapiens; identical to SEQ ID NO: 535240
  misc_feature: HIJSMM301EY2ZY.47.60.F05.1.454.light.4.raw

SEQ ID NO: 555825 - DNA, 488 bp, Homo sapiens
  misc_feature: HIJSMM301BLKCG.43.33.C11.1.454.light.4.raw
tgtgagtagtcacgaccggtgctcgatttagagtgagctcgttgggtttgggggcagaagtctctctcagtcaggacacagcatggacatgagggtccctgctcagctcctgggactcctgctgctctggctcccagcagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttgggtcccacctcggttcagtggcaacggctctgagacagatttttctctcgtcatcactggtctacagtctgacgacggcgcaatgtacttctgtcaacactatgcctctcccccctacaatttcggtcaggggaccaagttgaacatcaatcgaactgtggctgcacc

SEQ ID NO: 555826 - DNA, 500 bp, Homo sapiens
  misc_feature: HIJSMM301A2JNV.5.24.C02.1.454.light.4.raw
atcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaagctgaccgtccctaggtcagcccaaggcgt

SEQ ID NO: 555827 - DNA, 505 bp, Homo sapiens
  misc_feature: HIJSMM301CX7C4.13.11.A11.1.454.light.4.raw
tcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggagtccccagccgcttctctggatccaaggatgattccgccaacgcagggatattactcatctctgggctccagtctgacgatgaggctgactattactgtttgacttggcacaacaacgcctggatcttcggacctgggaccacggtcaccgtcctaggtcagcccaaggccaaccccactgtcactctgttcccc

SEQ ID NO: 555828 - DNA, 494 bp, Homo sapiens; identical to SEQ ID NO: 534992
  misc_feature: HIJSMM301AJJ0V.9.1.A01.1.454.light.4.raw

SEQ ID NO: 555829 - DNA, 476 bp, Homo sapiens
  misc_feature: HIJSMM301CTE6G.7.76.G10.1.454.light.4.raw
cgtgtctctacacgaccggtgctcgatttagtcactcatacagggggcaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagcccctaaactcctgatctctgctgcatccagtttacaaagtgggtcccatcgcggttcagcggcagtggatatgggacatatttcactctcgccatcagcagcctgcagcctgaagattttgcaacttactattgtcaacaggctaacagtttcccgctcaccttcggcgggggaccaacggtggagatcaacgaactgtggctgcac

SEQ ID NO: 555830 - DNA, 491 bp, Homo sapiens
  misc_feature: HIJSMM301DMRVV.13.87.H10.1.454.light.4.raw
tcacgtactacacgaccggtgctcgatttagcagtactgcgttgggtttgggggagtcagtcccagtcaggacacagcatggacatgagggtccccgctcagctcctggggctcctgctgctctggctcccaggtgccagatgtgacatccagttgacccagtctccatccttcccgtctgcatctgtaggagacagagtcaccatcacttgccgggccagtcaggacattaacagttatttagtctggtatcagcaaaaaccagggaaagtccctaagctcctgatctatgttgcatccactttgcaaagtggggtcccatcaaggttcagcggcagtggatctgggacagaattcactctcacaatcagcagcctgcagcctgaagattttgcaacttattactgtcaacagcttaatagttacccgctcagtttcggcggagggaccaaggtggagatcaaacgaactgtggctgcaccatctgtctt

SEQ ID NO: 555831 - DNA, 484 bp, Homo sapiens; identical to SEQ ID NO: 536162
  misc_feature: HIJSMM301AP4ST.13.59.F04.1.454.light.4.raw

SEQ ID NO: 555832 - DNA, 483 bp, Homo sapiens; identical to SEQ ID NO: 535413
  misc_feature: HIJSMM301DH2J9.26.78.H01.1.454.light.4.raw

SEQ ID NO: 555833 - DNA, 480 bp, Homo sapiens; identical to SEQ ID NO: 535291
  misc_feature: HIJSMM301ENNNO.22.59.F04.1.454.light.4.raw

SEQ ID NO: 555834 - DNA, 522 bp, Homo sapiens
  misc_feature: HIJSMM301DE3U7.53.77.G11.1.454.light.4.raw
cgcgtatacacacgaccggtgctcgatttagctagtcactcaagggaaaggggagtctgggcctaaggaagcagcactggtggtgcctcagccatggcctggaccgttctcctcctcggcctcctctctcactgcacaggctctgtgacctcctttgtgctgactcagtcaccctcggtgtcggtggccccaggacagacggccaggattacctgtgggggaaacaacattggaaggaaagtgtgcactggtaccagcagatgccaggccaggcccctgtgttggtcgtctatgatgatagcgaccggccctcaggggtccctgagcgattctctggctccaactctgggaacacggccaccctgaccataagcagggtcgaagccggggatgaggccgactattactgtcaggtgtgggatactagtagtgatcatccttgggtgttcggcggtgggaccaggctgaccgtcctaggtcagcccaaggctgccccctcggtcactctgttcccaccctcct

SEQ ID NO: 555835 - DNA, 487 bp, Homo sapiens; identical to SEQ ID NO: 536206
  misc_feature: HIJSMM301AQ6KC.47.38.D05.1.454.light.4.raw

SEQ ID NO: 555836 - DNA, 470 bp, Homo sapiens; identical to SEQ ID NO: 535302
  misc_feature: HIJSMM301A71SJ.13.76.G10.1.454.light.4.raw

SEQ ID NO: 555837 - DNA, 497 bp, Homo sapiens; identical to SEQ ID NO: 536371
  misc_feature: HIJSMM301D3F7W.16.78.H01.1.454.light.4.raw

SEQ ID NO: 555838 - DNA, 486 bp, Homo sapiens
  misc_feature: HIJSMM301APTBD.12.31.C09.1.454.light.4.raw
atacgacgtacacgaccggtgctcgatttagacgtctcatcaaggaaggaaggggcaggagtcagtctcagtcaggtcacagcatggacatgagggtccccgctcagctcctggggctcctgctactctggctccgaggtgccagatgtgacatccagctgacccagtctccatcctccctgtctgcatctgtaggagacaaagtcaccatcacttgccgggctaacgagagtattgccacgtatttaaattggtatcaacaaaaagcaggcaaagtcccaaagctcctgatttatgctgccaccagtctgcaaggtgggttcccgtcaaggttcactggccgtggatcagggacagaatttactctcaccatcagtagtctacagcctgaagatattgctacttattactgtcagcagagttaccgcgctcccatcactttcggccaagggacacaccgcagattggacgaactgtggctgcacc

SEQ ID NO: 555839 - DNA, 477 bp, Homo sapiens
  misc_feature: HIJSMM301C3RU8.52.9.A09.1.454.light.4.raw
cgcagtacgacacgaccggtgctcgatttagcgagacgcgcagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaagccagggaaagcccctaaactcctgatctctgctgcatctagtttgcatactgaggtcccatccaggttcagtggcggtggatctgggacagatttcactctcaccatcagcagtctgcaacctgaagattttgcaacttactactgtcaacagggttacggaaccctgctcatcttcggcggagggaccgaaaggtggaggatacaaacgaactagtggctga

SEQ ID NO: 555840 - DNA, 513 bp, Homo sapiens
  misc_feature: HIJSMM301CES4D.22.30.C08.1.454.light.4.raw
acatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggctgccccctcggtcactctgttcccgcctcctc

SEQ ID NO: 555841 - DNA, 493 bp, Homo sapiens; identical to SEQ ID NO: 535745
  misc_feature: HIJSMM301EFFJO.47.78.H01.1.454.light.4.raw

SEQ ID NO: 555842 - DNA, 474 bp, Homo sapiens; identical to SEQ ID NO: 535264
  misc_feature: HIJSMM301BP2JS.13.76.G10.1.454.light.4.raw

SEQ ID NO: 555843 - DNA, 510 bp, Homo sapiens
  misc_feature: HIJSMM301BYW6Q.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctcgggaccaaggtggagatcaaacgaactagtggctgcaccatctgtcttcta

SEQ ID NO: 555844 - DNA, 453 bp, Homo sapiens
  misc_feature: HIJSMM301BPCG5.18.78.H01.1.454.light.4.raw
tacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccactgtcactctgttcccgcctcctccatactcgta

SEQ ID NO: 555845 - DNA, 475 bp, Homo sapiens
  misc_feature: HIJSMM301CG1FE.40.59.F04.1.454.light.4.raw
tctagcgactcacgaccggtgctcgatttagtacacacacttagggattggggggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacgatcagcagtgaggtggttttcggcggagggaccaagctgaccgtcctaagtcagccc

SEQ ID NO: 555846 - DNA, 485 bp, Homo sapiens; identical to SEQ ID NO: 539691
  misc_feature: HIJSMM301CWMNQ.15.1.A01.1.454.light.4.raw
  modified_base (467)..(467): a, c, t, g, unknown or other

SEQ ID NO: 555847 - DNA, 383 bp, Homo sapiens; identical to SEQ ID NO: 447524
  misc_feature: HIJSMM301AEOUT.41.26.C04.1.454.light.4.raw

SEQ ID NO: 555848 - DNA, 487 bp, Homo sapiens; identical to SEQ ID NO: 536272
  misc_feature: HIJSMM301C7EDW.17.25.C03.1.454.light.4.raw

SEQ ID NO: 555849 - DNA, 489 bp, Homo sapiens; identical to SEQ ID NO: 535402
  misc_feature: HIJSMM301EAGUG.11.12.B01.1.454.light.4.raw

SEQ ID NO: 555850 - DNA, 459 bp, Homo sapiens; identical to SEQ ID NO: 547319
  misc_feature: HIJSMM301CX0MA.22.28.C06.1.454.light.4.raw

SEQ ID NO: 555851 - DNA, 506 bp, Homo sapiens
  misc_feature: HIJSMM301BJPIN.19.78.H01.1.454.light.4.raw
tactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaacccactgtcta

SEQ ID NO: 555852 - DNA, 420 bp, Homo sapiens; identical to SEQ ID NO: 540533
  misc_feature: HIJSMM301CTPRV.9.34.D01.1.454.light.4.raw

SEQ ID NO: 555853 - DNA, 485 bp, Homo sapiens; identical to SEQ ID NO: 541838
  misc_feature: HIJSMM301CAW3V.22.6.A06.1.454.light.4.raw

SEQ ID NO: 555854 - DNA, 506 bp, Homo sapiens
  misc_feature: HIJSMM301DZMGI.48.37.D04.1.454.light.4.raw
agtatacatacacgaccggtgctcgatttagtagcatactgttgggtttgggggctgtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactgggcccaggtggaggatgaaggtgactacttctgtttctcaacagacaccagtgacaatcatgcgattttcggcggagggaccaagctgaccgtcctgggtcagccaaggctgccccctcggtcactctcgtt

SEQ ID NO: 555855 - DNA, 422 bp, Homo sapiens; identical to SEQ ID NO: 537797
  misc_feature: HIJSMM301C1TJ4.9.34.D01.1.454.light.4.raw

SEQ ID NO: 555856 - DNA, 489 bp, Homo sapiens; identical to SEQ ID NO: 535139
  misc_feature: HIJSMM301E3U6W.14.55.E11.1.454.light.4.raw

SEQ ID NO: 555857 - DNA, 434 bp, Homo sapiens; identical to SEQ ID NO: 535153
  misc_feature: HIJSMM301C930T.18.5.A05.1.454.light.4.raw

SEQ ID NO: 555858 - DNA, 494 bp, Homo sapiens; identical to SEQ ID NO: 534994
  misc_feature: HIJSMM301DEV1R.27.78.H01.1.454.light.4.raw

SEQ ID NO: 555859 - DNA, 485 bp, Homo sapiens
  misc_feature: HIJSMM301BIXUC.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagtggcggtggatctagggcagatttcactctcaccatcaatcacctgcaggctgaggattttgcaacttactactgtcagcaggctaacaggctgcccccaaccttcggccaggggacacgactggagattaaacgaactgtggctgcaccatctgt

SEQ ID NO: 555860 - DNA, 485 bp, Homo sapiens; identical to SEQ ID NO: 535880
  misc_feature: HIJSMM301B1YFT.7.75.G09.1.454.light.4.raw

SEQ ID NO: 555861 - DNA, 510 bp, Homo sapiens
  misc_feature: HIJSMM301APOVM.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggtcttttcggcggagggaccaagctgaccgtccgtgggtcagcccaaggctcgccccctcggtctacc

SEQ ID NO: 555862 - DNA, 501 bp, Homo sapiens; identical to SEQ ID NO: 555551
  misc_feature: HIJSMM301BAWTK.21.81.H04.1.454.light.4.raw

SEQ ID NO: 555863 - DNA, 492 bp, Homo sapiens; identical to SEQ ID NO: 534967
  misc_feature: HIJSMM301C94R9.47.64.F09.1.454.light.4.raw

SEQ ID NO: 555864 - DNA, 487 bp, Homo sapiens; identical to SEQ ID NO: 536206
  misc_feature: HIJSMM301BSDT0.47.38.D05.1.454.light.4.raw

SEQ ID NO: 555865 - DNA, 513 bp, Homo sapiens
  misc_feature: HIJSMM301B6JLP.47.23.C01.1.454.light.4.raw
agctcacgtacacgaccggtgctcgatttagtacacgtgattagggattggggctgggcctaaggaagcagcactggtggtgcctcagccatggcctggaccgttctcctcctcggcctcctctctcactgcacagactctgtggcctcctatgtactgactcagccatcctcggtggcagtggccccaggacagacggccaggattccctgtggaggaaacaacattggaagtaagagtgtacattggtaccaacagaggccaggccaggcccctgtgctggtcgtccatgatgatagcgaccggccctcagggatccctgagcgcttctctggctccaattctgggaacacggccaccctgaccatcagcgcggtcgaagccggagatgaggccgactattactgtcaggtgtgggacagtaatagtgatcccgagcaggtttcggcggtgggaccaagctgaccgtcctaagtcagcccaaggctgccccctcggtcactctgttccccg

SEQ ID NO: 555866 - DNA, 495 bp, Homo sapiens; identical to SEQ ID NO: 535007
  misc_feature: HIJSMM301EV0CN.22.5.A05.1.454.light.4.raw

SEQ ID NO: 555867 - DNA, 490 bp, Homo sapiens; identical to SEQ ID NO: 536481
  misc_feature: HIJSMM301BJ16C.13.46.E02.1.454.light.4.raw

SEQ ID NO: 555868 - DNA, 445 bp, Homo sapiens; identical to SEQ ID NO: 542143
  misc_feature: HIJSMM301B630X.47.85.H08.1.454.light.4.raw

SEQ ID NO: 555869 - DNA, 494 bp, Homo sapiens; identical to SEQ ID NO: 534992
  misc_feature: HIJSMM301BHCHV.9.1.A01.1.454.light.4.raw

SEQ ID NO: 555870 - DNA, 483 bp, Homo sapiens; identical to SEQ ID NO: 542200
  misc_feature: HIJSMM301DTL7Y.7.75.G09.1.454.light.4.raw

SEQ ID NO: 555871 - DNA, 489 bp, Homo sapiens
  misc_feature: HIJSMM301AFPO0.3.33.C11.1.454.light.4.raw
agacgcactccacgaccggtgctcgatttagagtgagctcgttggggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccctcggtcactctgttcccgccctcctcga

SEQ ID NO: 555872 - DNA, 465 bp, Homo sapiens
  misc_feature: HIJSMM301CTVFH.5.36.D03.1.454.light.4.raw
atcagacacgcacgaccggtgctcgatttagctgcgtcacgatctctcttgggcacgaccggtgctcgatttagctgcgtcacgatctctcttgggggagtcagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtggggtcccaccaacgttcagcggcagtggatctgggacagagttcactctcaccatcagcagcctgcagcctgacgatgtggcaacttattactgccaacagtatgatt

SEQ ID NO: 555873 - DNA, 498 bp, Homo sapiens
  misc_feature: HIJSMM301A4144.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggccagcagtggtaacattgtgatattcggcggagggaccaaggtgaccgtcctacgtcagcccaaggctgccccctcggtccactctcg

SEQ ID NO: 555874 - DNA, 518 bp, Homo sapiens; identical to SEQ ID NO: 545878
  misc_feature: HIJSMM301EGM6G.41.25.C03.1.454.light.4.raw

SEQ ID NO: 555875 - DNA, 496 bp, Homo sapiens
  misc_feature: HIJSMM301DSS51.51.10.A10.1.454.light.4.raw
cgatcgtatacacgaccggtgctcgatttagcgtcgatctcaggggcagcttcagctgtgggtagagaagacaggactcaggacaatctccagcatggccagcttccctctcctcctcaccctcctcactcactgtgcagggtcctgggcccaatctgtgctgactcagccaccctcagcgtctgggacccccgggcagagggtcaccatctcctgttctggaagcaactccaacatcggaagttatactgcagactggtaccagcaactcccaggatcggcccccaaactcctcatctatactactaatcaacgggccacaggggtccctgaccgattctccggctccaagtctggcacctcagcctccctggccatcagtggtctccagtctgaggatgaggctcaatacttctgtgcatcatgggatgacagtttgaatggtccggtgttcggcggagggaccaaactgaccgtcctagtcagcccaaggctg

SEQ ID NO: 555876 - DNA, 479 bp, Homo sapiens; identical to SEQ ID NO: 536050
  misc_feature: HIJSMM301DQYUH.5.73.G07.1.454.light.4.raw

SEQ ID NO: 555877 - DNA, 478 bp, Homo sapiens; identical to SEQ ID NO: 543315
  misc_feature: HIJSMM301B0547.26.72.G06.1.454.light.4.raw

SEQ ID NO: 555878 - DNA, 488 bp, Homo sapiens
  misc_feature: HIJSMM301DOLO2.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtggggtcccatcaaggttcagcggcagtgggtctgggacagaattcactctcaccatcagcagcctgcaacctgatgactttgcaacttattactgccaacagtataatggttatgaatccacttttggccaagggaccaagctggagatcaaacgaactgtggctgcaca

SEQ ID NO: 555879 - DNA, 493 bp, Homo sapiens; identical to SEQ ID NO: 535745
  misc_feature: HIJSMM301AS2DA.47.78.H01.1.454.light.4.raw

SEQ ID NO: 555880 - DNA, 495 bp, Homo sapiens
  misc_feature: HIJSMM301ECJA5.22.57.F02.1.454.light.4.raw
acatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcggcaatggatctgggacagaattcactctcaccatcaacagcctgcagcctgatgatttggcaacttactactgccaaccgtatagtacttattcggtcaccttcggccaagggacacgactggagattaaacgaaactgtggctgcaccatctgtcttcatt

SEQ ID NO: 555881 - DNA, 501 bp, Homo sapiens; identical to SEQ ID NO: 536818
  misc_feature: HIJSMM301CT3SG.12.82.H05.1.454.light.4.raw

SEQ ID NO: 555882 - DNA, 494 bp, Homo sapiens; identical to SEQ ID NO: 534992
  misc_feature: HIJSMM301AQY1Y.9.1.A01.1.454.light.4.raw

SEQ ID NO: 555883 - DNA, 489 bp, Homo sapiens
  misc_feature: HIJSMM301A5ZL1.40.22.B11.1.454.light.4.raw
tctagcgactcacgaccggtgctcgatttagacgacagctcagggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgaatagtaatggatacaactatttggattggtacctgcagaagccagggcagtgtccacagctcctgatctatttgggttctaatcgggcctccggggtccctgacaggttcagtggcagtggatcaggtacagattttacactgaaaatcagcagggtggaggcagaagatgttgggatttattactgcatgcaacctctacaaactgtgtggacgtcggccaagggaccaaaggtggaaatcaagcgaactgtggctgcacc

SEQ ID NO: 555884 - DNA, 492 bp, Homo sapiens; identical to SEQ ID NO: 542642
  misc_feature: HIJSMM301BHJBO.51.81.H04.1.454.light.4.raw

SEQ ID NO: 555885 - DNA, 502 bp, Homo sapiens
  misc_feature: HIJSMM301ETCGY.2.76.G10.1.454.light.4.raw
  modified_base (434)..(434): a, c, t, g, unknown or other
  modified_base (461)..(461): a, c, t, g, unknown or other
acgctcgacacacgaccggtgctcgatttagtcactcatacagggggagagatctggggaaggctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggcagagggtcaccatctcttgttctggaggcacctccaacatcgggcgtgataatgtgtactggtacaagcaggtcccaggaacgacccccaaactcctcatctctcacaataatcagcggccctcaggagtccctgaccgattctctgcctccaagtccggcacctcagcctccctggccatcagtgggctccgggccgaggatgaggctgattattacngtgcaggatgggatgacaacctgggtncttatctcttcggacctgggaccaaggtcaccgtccttggt

SEQ ID NO: 555886 - DNA, 442 bp, Homo sapiens
  misc_feature: HIJSMM301CF3XY.11.3.A03.1.454.light.4.raw
  modified_base (423)..(423): a, c, t, g, unknown or other
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgccccctcggtcactctgttcccnccctcctccgtatctctcg

SEQ ID NO: 555887 - DNA, 503 bp, Homo sapiens
  misc_feature: HIJSMM301D9L6F.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcttcggccaagggaccaaggtggaaatcaaacgaactagtggctgcaccatctgtcttcatcttccccg

SEQ ID NO: 555888 - DNA, 494 bp, Homo sapiens
  misc_feature: HIJSMM301D1F0S.43.37.D04.1.454.light.4.raw
tgtgagtagtcacgaccggtgctcgatttagtagcatactgttgggtttggggcagcttcagctgtgggtagagaagacaggactcaggacaatctccagcatggccagcttccctctcctcctcaccctcctcactcactgtgcagggtcctgggcccagtctgtggtgactcagccaccctcagcgtctgggacccccggacagagggtcagcatctcctgttctggaagcagctccaacattggacgtaatactgtaaactggtaccagcaactcgcaggaacggcccccaaactcctcatctatgaccatcatcagcggccctcaggggtccctgaccgattctctggctccaagtctggctcttcagcctccctggccatcagtgggctccagtctgaggatgaggctgattattactgtgcagcgtgggatgacagcctgaatgcttgggtgttcggcggagggaccaaggtgaccgtctaggtcacg

SEQ ID NO: 555889 - DNA, 490 bp, Homo sapiens
  misc_feature: HIJSMM301D98YH.11.28.C06.1.454.light.4.raw
cgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggtttcagcagaggccaggccaatctccaaggcgcctaatttataaggtttctaggcgggactctggggtcccagacagattcagcggcagtgggtcaggcgctgatttcacactgagaatcagcagggtggaggctgaagatgtcggggtttattactgcatgcagggtacagtgtggccttcgctcgcattcggcggagggaccgaaggtggaggatcaaacgaa

SEQ ID NO: 555890 - DNA, 478 bp, Homo sapiens
  misc_feature: HIJSMM301A1WWC.48.76.G10.1.454.light.4.raw
agtatacatacacgaccggtgctcgatttagtcactcatacagggggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagcggcagtggatctggcacagagttcactctcaccatcagcaccctgcagcctgaagattttgcgacttatttctgtctacaagattctaatttaccctcggacgttcggtccaggggaccaaagtggatgtcaaccgaactgtggctgcacca

SEQ ID NO: 555891 - DNA, 503 bp, Homo sapiens
  misc_feature: HIJSMM301DTLKN.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcggccaagggaccaaggtggaaatcaaacgaactgtggctgcaccatctgtcttcatcttccccg

SEQ ID NO: 555892 - DNA, 483 bp, Homo sapiens; identical to SEQ ID NO: 540738
  misc_feature: HIJSMM301AF6J4.48.85.H08.1.454.light.4.raw

SEQ ID NO: 555893 - DNA, 503 bp, Homo sapiens; identical to SEQ ID NO: 538884
  misc_feature: HIJSMM301CPHKL.27.78.H01.1.454.light.4.raw

SEQ ID NO: 555894 - DNA, 501 bp, Homo sapiens; identical to SEQ ID NO: 535746
  misc_feature: HIJSMM301DRJ8E.18.11.A11.1.454.light.4.raw

SEQ ID NO: 555895 - DNA, 499 bp, Homo sapiens
  misc_feature: HIJSMM301CEN4S.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctcccctgaccatctctgggctccaggctgaggacgaggctgattattactgcagctcatatacaagcaccagcactctctatgtcttcggaactgggaccaaggtcaccgtcctaggtcagcccaagga

SEQ ID NO: 555896 - DNA, 495 bp, Homo sapiens
  misc_feature: HIJSMM301CQ0LW.52.35.D02.1.454.light.4.raw
cgcagtacgacacgaccggtgctcgatttagcacacgatagttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctcctcctcagggacaacagtcacgttgatcatcagtggagtcgggcagaggacgaggctgactattactgtcaatcaacagacagtagtggtacttatgtgcagttcggcggagggaccaagctgaccgtcctaggtcagcccaaggctgccccctggtca

SEQ ID NO: 555897 - DNA, 508 bp, Homo sapiens
  misc_feature: HIJSMM301EAOEP.41.19.B08.1.454.light.4.raw
tctatactatcacgaccggtgctcgatttagtgagtcagtaagggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctgatcgcttctctggctccaagtctggcaatacggcctccctgacagtctctcggctccaggcggaggacgaggctgattactactgcttctcatatgcagatactaagtcctgggtgttcggcggagggaccaagctgaccgtcctaggtcagcccaaggctgccccctcggtcactctcg

SEQ ID NO: 555898 - DNA, 504 bp, Homo sapiens
  misc_feature: HIJSMM301BCGOU.43.15.B04.1.454.light.4.raw
tgtgagtagtcacgaccggtgctcgatttagacagtatatatccgcgggggggtcagagctctggggaggaactgctcagttaggacccagacggaaccatggaagccccagcgcagcttctcttcctcctgctactctggctcccagaaaccactggagaaatagtgatgacgcagtctccagccaccctgtctttgtctccaggggaaagagccaccctctcatgcagggccagtcagagtgttagcaccaacgtggcctggtaccagcagaaacctggccagcctccccggctcctcatctctggtgcatcctccagggccactggttccccagccaggttcagtggcagtgggtctgggacagagttcactctcaccatcagcagccttcagtctgaagattttgcagtttattactgtcaccagtatcataactggcctccaagggggactttcggccaaggaccaaggtggaattcaaccgaactgtggctgcaccat

SEQ ID NO: 555899 - DNA, 518 bp, Homo sapiens
  misc_feature: HIJSMM301AGM52.41.11.A11.1.454.light.4.raw
  modified_base (508)..(508): a, c, t, g, unknown or other
tctatactatcacgaccggtgctcgatttagctacgactgcagggggaggaactgctcagttaggacccagacggaaccatggaagccccagcgcagcttctcttcctcctgctactctggctcccagataccactggagaaatagtggtgacgcagtctccagccaccctgtctgtgtctccaggggaaggagccaccctctcctgcagggccagtcagagtattagcagcagcttagcctggtaccagcagaagcctggccaggctcccaggctcctcgtctatggtgcatccaccagggccactggtatcccagccaggttcagtggcagtgggtctgggacagagttcactctcaccatcaccagcctgcagtctgaagattttggagtttatttctgtcaccagtataaggactggccttggacgtttggtcgacgggaccgaaggcggtaggagtataacgaacgtacgtaggtcgtggctacgactacctacgtcttcgtnttccttcccg

SEQ ID NO: 555900 - DNA, 498 bp, Homo sapiens; identical to SEQ ID NO: 547944
  misc_feature: HIJSMM301CB6FY.41.53.E09.1.454.light.4.raw

SEQ ID NO: 555901 - DNA, 482 bp, Homo sapiens; identical to SEQ ID NO: 546483
  misc_feature: HIJSMM301EOL7H.3.38.D05.1.454.light.4.raw

SEQ ID NO: 555902 - DNA, 506 bp, Homo sapiens
  misc_feature: HIJSMM301AUV8O.18.23.C01.1.454.light.4.raw
  modified_base (362)..(362): a, c, t, g, unknown or other
tacgagtatgcacgaccggtgctcgatttagtacacgtgattagggattgggggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaagcccctaagctgcagatgattggtccgtccagtttccaagatggggccccatcgagattccgcgtcaagtggatctggggacagatttcacnctcaccatcagcagcctgcagcctgaagattttgcaacttactattgtcagcaggcgcacaattttcccgctcactttcggcggagggaccaaggtggagatcaaacgaaactgtggctgcaccatctgtcttcatcttccccg

SEQ ID NO: 555903 - DNA, 494 bp, Homo sapiens; identical to SEQ ID NO: 535276
  misc_feature: HIJSMM301C15CJ.16.6.A06.1.454.light.4.raw

SEQ ID NO: 555904 - DNA, 513 bp, Homo sapiens
  misc_feature: HIJSMM301CG0D6.13.38.D05.1.454.light.4.raw
tcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcggtccaacggagtcaaggtaggaaagtacaagcgaactacgtggcgtgtcaccactctgtcttctatcttccccg

SEQ ID NO: 555905 - DNA, 512 bp, Homo sapiens
  misc_feature: HIJSMM301BRGAS.43.41.D08.1.454.light.4.raw
tgtgagtagtcacgaccggtgctcgatttagtcacgcgagaaagggaaagggggagctacaacaggcaggcaggggcagcaagatggtgttgcagacccaggtcttcatttctctgttgctctggatctctggtgcctacggggacgtcgtgatgacccagtctccagactccctggcagtgtctctgggcgggagggccaccatcaactgcaagtccagccagagtattttatacagctcctacaataagagcgacttagcttggtaccagcagaaaccaggacagcctcctaagttgctcatttactgggcatctaaccggcaatccggggtccctgaccgattcagtggcagcgggtctgggacacatttcgctttcaccatcagcagcctgcaggctgaggatgtggcagtttattactgtcagcaatattatactaacgtccgtggactttcggccaacggaccgaaagtaggtaaagtacaagacaaacgtagtggctgcaccaat

SEQ ID NO: 555906 - DNA, 506 bp, Homo sapiens; identical to SEQ ID NO: 534969
  misc_feature: HIJSMM301DPHVJ.18.37.D04.1.454.light.4.raw

SEQ ID NO: 555907 - DNA, 504 bp, Homo sapiens
  misc_feature: HIJSMM301AM9FE.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcgggcggaggggaccaaactgaccgtcctaggtcagcccaa

SEQ ID NO: 555908 - DNA, 461 bp, Homo sapiens; identical to SEQ ID NO: 544726
  misc_feature: HIJSMM301CP13D.18.59.F04.1.454.light.4.raw

SEQ ID NO: 555909 - DNA, 511 bp, Homo sapiens
  misc_feature: HIJSMM301AV24W.10.80.H03.1.454.light.4.raw
catagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctgtgggggagacagcattgaaagtgaagctgtccactggtaccagcagaggccaggccaggcccctgtactggtcctctatgatgatagtgaccggccctcagggatccctgagcgattctctggctccaactctgggaacacggccaccctgaccatcaccagggtcgaagccggggatgaggccgactattattgtcaggtgtggtatttcagtagtattcatccgggggttttggcggagggaccaagctgaccgtcctaggtcagcccaaggctgccccctggtcactctgttccca

SEQ ID NO: 555910 - DNA, 497 bp, Homo sapiens
  misc_feature: HIJSMM301A806E.52.34.D01.1.454.light.4.raw
cgcagtacgacacgaccggtgctcgatttagatcgtctgtgttgggtttgggggaactgctcagttaggacccagagggaaccatggaagccccagctcagcttctcttcctcctgctactctggctcccagataccaccggagaagttgtattgacacagtctccagccaccctgtctttgtctccaggggggagagccaccctctcctgcagggccagtcagagtgttggcaacctcttagcctggtaccaacaaaaacctggccaggctcccaggctcctcatctatgatgcatccacgagggccactggcatcccagccaggttcagtggcagtgggtctgagacagacttcactctcaccatcagtggcctcgagcctgaagattttgcagtttattactgtcagcagcgtagccactggctctctttcggcggagggaccaaggttgagatcaaacgaactgtggctgcaccatctgtcttcatcttcccg

SEQ ID NO: 555911 - DNA, 454 bp, Homo sapiens; identical to SEQ ID NO: 534964
  misc_feature: HIJSMM301C8J7D.19.86.H09.1.454.light.4.raw

SEQ ID NO: 555912 - DNA, 486 bp, Homo sapiens
  misc_feature: HIJSMM301DECKI.12.8.A08.1.454.light.4.raw
atacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccagcatcacctgctctggagatgtattgactaatgagtatgcttcctggtatcagcagaaggcaggccagccccctgtcctactcatctttcaaaataccaggcggccctctggggtccctgagcgattctctggctccgactctgggaacacagtcactctgaccatcagcgggacccaggctattgatgaggctgtctactactgtcaggcgtgggacagcagcgtggtgttcgggcggagggaccagtctgaccgtcttaggtcagcccaaggctgccccctcggtctac

SEQ ID NO: 555913 - DNA, 495 bp, Homo sapiens; identical to SEQ ID NO: 536055
  misc_feature: HIJSMM301ERC1P.47.38.D05.1.454.light.4.raw

SEQ ID NO: 555914 - DNA, 470 bp, Homo sapiens
  misc_feature: HIJSMM301A1RVC.4.79.H02.1.454.light.4.raw
agcactgtagcacgaccggtgctcgatttagtgtcacacgaagggaaaggggagtcagactcagtcaggacacagcatggacatgagggtccccgctcagctcctggggctcctgctgctctggctcccaggtgccaaatgtgacatccagctgacccagtctccctccaccctgtctgcatctataggagacagagtcaccatcacttgccgggccagtcagagtattagtaactggttggcctggtatcagcagaaaccaggcaaagccccaaagctcctcatctctgatgcctccactctgcacggtggcgtcccgccaacgttcagcggcagcggatctgggacagaattcagcctcaccatcagcagcctgcagcctgatgatgttgcaacttactactgtcaacaatataacagttactggacgttcggccaagggaccaaggtggaactcaaacgaactgtgg

SEQ ID NO: 555915 - DNA, 501 bp, Homo sapiens; identical to SEQ ID NO: 537690
  misc_feature: HIJSMM301C0879.41.14.B03.1.454.light.4.raw

SEQ ID NO: 555916 - DNA, 488 bp, Homo sapiens; identical to SEQ ID NO: 537260
  misc_feature: HIJSMM301A0983.47.70.G04.1.454.light.4.raw

SEQ ID NO: 555917 - DNA, 519 bp, Homo sapiens
  misc_feature: HIJSMM301CTD6S.48.24.C02.1.454.light.4.raw
agtatacatacacgaccggtgctcgatttagtacagatcgttagggaaaggggctgggcctaaggaagcagcactggtggtgcctcagccatggcctggaccgttctcctcctcggcctcctctctcactgcacaggctctgtgacctcctatgttctgactcagccaccctcggtgtcagtggccccaggaaagacggccaggattacctgtggaggaaacaacattggaagtaaaagtgtgcactggtaccagcagaagccaggccaggcccctgtgctggtcgtctttgatgataccgaccggccctcagggatccctgagcgattctctggctccaactctgtgaacacggccaccctgaccatcagcagggtcgaagccgggatgaggccgactattactgtcaggtgtgggatagtagtagtgatcatcctaattgggtgttcggcggagggaccaagctgaccgtcctaggtcagcccaaggctgccccctcggtcactctgttcccgccct

SEQ ID NO: 555918 - DNA, 485 bp, Homo sapiens; identical to SEQ ID NO: 550410
  misc_feature: HIJSMM301BUEWK.14.53.E09.1.454.light.4.raw

SEQ ID NO: 555919 - DNA, 494 bp, Homo sapiens; identical to SEQ ID NO: 534994
  misc_feature: HIJSMM301BYO53.27.78.H01.1.454.light.4.raw

SEQ ID NO: 555920 - DNA, 447 bp, Homo sapiens; identical to SEQ ID NO: 535020
  misc_feature: HIJSMM301EE8KU.18.9.A09.1.454.light.4.raw

SEQ ID NO: 555921 - DNA, 504 bp, Homo sapiens; identical to SEQ ID NO: 535077
  misc_feature: HIJSMM301B74PD.8.28.C06.1.454.light.4.raw

SEQ ID NO: 555922 - DNA, 504 bp, Homo sapiens
  misc_feature: HIJSMM301B6GDU.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtaggaaagtcaaacgaactgtggctgcaccatctgtcttcatcttccccg

SEQ ID NO: 555923 - DNA, 486 bp, Homo sapiens; identical to SEQ ID NO: 535385
  misc_feature: HIJSMM301CUW0S.19.71.G05.1.454.light.4.raw

SEQ ID NO: 555924 - DNA, 513 bp, Homo sapiens
  misc_feature: HIJSMM301APHMU.21.87.H10.1.454.light.4.raw
tcgtcgctcgcacgaccggtgctcgatttagcagtactgcgttggggtttggggggggtcgacaagaggcagcgctctcgggacggtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacgttttaaccttgtctcctggtatcaacaacaccaggacaaagccccaaactcttaatttctggcgtcaatcagcgaccctcacatgtttccagtcgattctctgcatccaagtctggcaacacggcctttctgacaatctctcaactccaggctgaagacgaggctatttattactgctcctcatacgcaggtggcactatttttcttggtttttggtcggcgggacccagatgactgtcctcagtcagcccaaggctcgccccctccggt

SEQ ID NO: 555925 - DNA, 508 bp, Homo sapiens
  misc_feature: HIJSMM301D9K81.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaattagagatcaaacgaactagtggctgcaccatctgtcttcatcttcccgccact

SEQ ID NO: 555926 - DNA, 495 bp, Homo sapiens
  misc_feature: HIJSMM301ETCEF.9.1.A01.1.454.light.4.raw
  modified_base (485)..(485): a, c, t, g, unknown or other
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctggggacagacttcactctcaccatcagcagactggagcctgaggattttgcagtgtattactgtcagcagtatcataggtcaaacaccttggcccaagggacacgactggagattaaaggaactgtggctgcaccatctgtcttnatcttccccg

SEQ ID NO: 555927 - DNA, 469 bp, Homo sapiens
  misc_feature: HIJSMM301AVMWJ.51.77.G11.1.454.light.4.raw
cgatcgtatacacgaccggtgctcgatttagctagtcactcaagggaaagggggagtcagtcccaaccaggacacagcatggacatgagggtccctgctcagctcctggggctcctgctgctctggctctcaggtggcagatgtatcatccagatgacccagtctccatcctccctgtctgcatatataggagacagaatcaccatcacttgccgggcgagtcaggacattagcgtatatttgaattggtatcagcaaaaaccagggaaagcccctgagctcctgatcctcgatgcatccactttggaaacaggggtcccatcaaggttcagtggaagtggctctgggacacattttactttcaccatcagcagactgcagcctgaagatgttgcaacatattactgtcaacagtatcataatctcccgctcactttcggcggagggaccaaggtggagatcaaacgaa

SEQ ID NO: 555928 - DNA, 492 bp, Homo sapiens; identical to SEQ ID NO: 539630
  misc_feature: HIJSMM301A6P10.22.25.C03.1.454.light.4.raw

SEQ ID NO: 555929 - DNA, 486 bp, Homo sapiens; identical to SEQ ID NO: 542999
  misc_feature: HIJSMM301EAINV.17.55.E11.1.454.light.4.raw

SEQ ID NO: 555930 - DNA, 497 bp, Homo sapiens
  misc_feature: HIJSMM301EGIHW.22.86.H09.1.454.light.4.raw
acatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgcttgctcatttgcaggcgcctacacttgggtgttcggcggagggaccaagcttgaccgtcctaggtcagcccaaggctgccccctcggtcactctgttcccgcctcct

SEQ ID NO: 555931 - DNA, 491 bp, Homo sapiens
  misc_feature: HIJSMM301D6WDF.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgtttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgaactgtggctgcaccatctgtcttcatcttcccgccat

SEQ ID NO: 555932 - DNA, 490 bp, Homo sapiens
  misc_feature: HIJSMM301EM3WQ.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgcaacagtatcatcatcattgtaatttcggtggagggaccaaggtggaggtcaaacgaactgtggctgcaccatctgtcttcatt

SEQ ID NO: 555933 - DNA, 505 bp, Homo sapiens; identical to SEQ ID NO: 546621
  misc_feature: HIJSMM301AFPZ7.15.86.H09.1.454.light.4.raw

SEQ ID NO: 555934 - DNA, 520 bp, Homo sapiens
  misc_feature: HIJSMM301A4QGP.5.27.C05.1.454.light.4.raw
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgttcccaccctcctccgtcgt

SEQ ID NO: 555935 - DNA, 484 bp, Homo sapiens; identical to SEQ ID NO: 535400
  misc_feature: HIJSMM301EFR0T.46.26.C04.1.454.light.4.raw

SEQ ID NO: 555936 - DNA, 484 bp, Homo sapiens
  misc_feature: HIJSMM301DWG13.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctgttcccaccctcctcgctcgtaga

SEQ ID NO: 555937 - DNA, 492 bp, Homo sapiens; identical to SEQ ID NO: 534967
  misc_feature: HIJSMM301EZAX9.47.64.F09.1.454.light.4.raw

SEQ ID NO: 555938 - DNA, 497 bp, Homo sapiens
  misc_feature: HIJSMM301A1X20.15.67.G01.1.454.light.4.raw
tctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagatttcactctcaccatcagcagcctgcagcctgaagatttcgcaacttattactgtctacaagattacaattaccctcggacgttcggtccaggggaccgaacggtggaaagtacaaacgaaacctagtggcgtgcgacca

SEQ ID NO: 555939 - DNA, 471 bp, Homo sapiens
  misc_feature: HIJSMM301EXS45.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcactttcgcctggactgaagtgcatatgaagagaatgtgctgca

SEQ ID NO: 555940 - DNA, 486 bp, Homo sapiens; identical to SEQ ID NO: 535043
  misc_feature: HIJSMM301AHBTW.46.35.D02.1.454.light.4.raw

SEQ ID NO: 555941 - DNA, 502 bp, Homo sapiens
  misc_feature: HIJSMM301E0S32.12.82.H05.1.454.light.4.raw
atacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccaggggaaagagccaccctctcctgcagggccagtgagaatgttaacaacaggtatctggcctggtaccagcagaaacctggccaggctcccaggctcctcatgtacgttacttccagcagggccactggcatcccagacaggttcactggcagtgggtctgggacagacttcactctcaccatcaccagactggagcctgaagattttgcagtgtattattgtcagcagtatggtagcgcaccgtacacttttggccaggggtccaagctggagatgaaacgaactagtggctgcaccatctgtcttcatcttccccg

SEQ ID NO: 555942 - DNA, 504 bp, Homo sapiens; identical to SEQ ID NO: 535709
  misc_feature: HIJSMM301A57U0.9.55.E11.1.454.light.4.raw

SEQ ID NO: 555943 - DNA, 488 bp, Homo sapiens
  misc_feature: HIJSMM301BB44W.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctcgccccctcggtccactctcgttcccgccctcctcgctacgtaga

SEQ ID NO: 555944 - DNA, 488 bp, Homo sapiens; identical to SEQ ID NO: 537329
  misc_feature: HIJSMM301CING6.26.23.C01.1.454.light.4.raw

SEQ ID NO: 555945 - DNA, 509 bp, Homo sapiens; identical to SEQ ID NO: 552678
  misc_feature: HIJSMM301CM7JR.11.57.F02.1.454.light.4.raw

SEQ ID NO: 555946 - DNA, 473 bp, Homo sapiens
  misc_feature: HIJSMM301DFOCP.51.1.A01.1.454.light.4.raw
cgatcgtatacacgaccggtgctcgatttagacgtctcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaagcggccctcggggatacctgagcgattctctggctccacctctgggaacacagccactctgaccatcagcgggacgcaggctgtggatgaggctgacttttactgtcaggcgtgggacagcgacactgccgtgttcggcggagggaccaagctgaccgtcctcggtcagccc

SEQ ID NO: 555947 - DNA, 483 bp, Homo sapiens
  misc_feature: HIJSMM301DMTZO.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcaccgtctaggtcagccaaggccaaccc

SEQ ID NO: 555948 - DNA, 494 bp, Homo sapiens; identical to SEQ ID NO: 534992
  misc_feature: HIJSMM301BWZK8.9.1.A01.1.454.light.4.raw

SEQ ID NO: 555949 - DNA, 518 bp, Homo sapiens
  misc_feature: HIJSMM301A3DWE.41.25.C03.1.454.light.4.raw
tctatactatcacgaccggtgctcgatttagtagtgtagatttgggtttggggatagctcaggaagcagagcctggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctggggtcccctttcggttttctggctccatcgacagtccctccaactccgcctcccttaccatatctgggctgaagagtgaggacgaggctgactacttctgtcagtcttatgatataaacaattatgtgataattggcggagggaccagggtgaccgtcctaggtcagcccaaggctgccccctcggtcactctgttcccta

SEQ ID NO: 555950 - DNA, 494 bp, Homo sapiens
  misc_feature: HIJSMM301BP4HD.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgcagtttattactgtcagcagtataattactggcctcggacgttcggccgaagggaccgaaggtggaagtacaacgaactagtggctgcaccatctgtctt

SEQ ID NO: 555951 - DNA, 503 bp, Homo sapiens
  misc_feature: HIJSMM301DGD6U.48.53.E09.1.454.light.4.raw
agtatacatacacgaccggtgctcgatttagagagagtgtgttgggtttggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcaccatctgtcttcatcttccccg

SEQ ID NO: 555952 - DNA, 454 bp, Homo sapiens; identical to SEQ ID NO: 535005
  misc_feature: HIJSMM301BTVOF.19.86.H09.1.454.light.4.raw

SEQ ID NO: 555953 - DNA, 505 bp, Homo sapiens; identical to SEQ ID NO: 535987
  misc_feature: HIJSMM301DT0O7.18.37.D04.1.454.light.4.raw

SEQ ID NO: 555954 - DNA, 488 bp, Homo sapiens
  misc_feature: HIJSMM301DABPT.26.37.D04.1.454.light.4.raw
agactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagcctggtaccagcagacacctgggcagactcccaggctcctcatttatgctgcatccaccagggccactggtatcccagccaggttcagtggcagtgggtctgggacagagttcactctcaccatcagcagcctgcagtctgaagattgtgcaatttattactgtcagcaatataatacctggccttccgctcactttcggcggagggaccaaggttgagatcaaacgaactgtggctgcacc

SEQ ID NO: 555955 - DNA, 496 bp, Homo sapiens; identical to SEQ ID NO: 535109
  misc_feature: HIJSMM301BBRLO.16.78.H01.1.454.light.4.raw

SEQ ID NO: 555956 - DNA, 494 bp, Homo sapiens; identical to SEQ ID NO: 539065
  misc_feature: HIJSMM301EQ8PR.11.81.H04.1.454.light.4.raw

SEQ ID NO: 555957 - DNA, 521 bp, Homo sapiens; identical to SEQ ID NO: 539470
  misc_feature: HIJSMM301B8CFR.27.23.C01.1.454.light.4.raw

SEQ ID NO: 555958 - DNA, 444 bp, Homo sapiens; identical to SEQ ID NO: 535192
  misc_feature: HIJSMM301APY66.5.9.A09.1.454.light.4.raw

SEQ ID NO: 555959 - DNA, 487 bp, Homo sapiens; identical to SEQ ID NO: 543166
  misc_feature: HIJSMM301B5BYI.5.23.C01.1.454.light.4.raw

SEQ ID NO: 555960 - DNA, 447 bp, Homo sapiens; identical to SEQ ID NO: 535201
  misc_feature: HIJSMM301DKUCS.18.9.A09.1.454.light.4.raw

SEQ ID NO: 555961 - DNA, 516 bp, Homo sapiens
  misc_feature: HIJSMM301EM1LD.8.87.H10.1.454.light.4.raw
  modified_base (484)..(484): a, c, t, g, unknown or other
ctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagtgtcagtggccctgggacagacggccagaattacctgtggaggagtcaacattgggacttcagatgtgcactggtaccagcagaagccaggccaggcccctgtactggtcatctttagcgattccaaccggccctctgggatccctgagcgattctctggctccaagtcggggaacacggccaccctgaccatcagcagggcccaacccttggatgaggtgactatttctgtcaagtgtgggacaccaacacttgtgtcttcgggactgggaccgaggtcaccgtcctaagtcagcccaggccaacccnctagtcactctgttcccgcctcctcgactacg

SEQ ID NO: 555962 - DNA, 495 bp, Homo sapiens; identical to SEQ ID NO: 535007
  misc_feature: HIJSMM301AS1LS.22.5.A05.1.454.light.4.raw

SEQ ID NO: 555963 - DNA, 517 bp, Homo sapiens; identical to SEQ ID NO: 536262
  misc_feature: HIJSMM301AZWOM.14.70.G04.1.454.light.4.raw

SEQ ID NO: 555964 - DNA, 500 bp, Homo sapiens
  misc_feature: HIJSMM301CJRX0.2.76.G10.1.454.light.4.raw
  modified_base (461)..(461): a, c, t, g, unknown or other
acgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggcagagggtcaccatctcttgttctggaggcacctccaacatcgggcgtgataatgtgtactggtacaagcaggtcccaggaacgacccccaaactcctcatctctcacaataatcagcggccctcaggagtccctgaccgattctctgcctccaagtccggcacctcagcctccctggccatcagtgggctccgggccgaggatgaggctgattattactgtgcaggatgggatgacaacctgggtncttatctcttcggacctgggaccaaggtcaccgtctggt

SEQ ID NO: 555965 - DNA, 504 bp, Homo sapiens
  misc_feature: HIJSMM301CH3L1.48.36.D03.1.454.light.4.raw
agtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgaccatctctgggctccaggctgaagatcaggctgattattactgctgttcattttcaagttcctttttgtcttcggaactgggaccgaggtcaccgtcctaggtcagcccaaggccaaccccactgtcta

SEQ ID NO: 555966 - DNA, 474 bp, Homo sapiens; identical to SEQ ID NO: 535264
  misc_feature: HIJSMM301DTQV8.13.76.G10.1.454.light.4.raw

SEQ ID NO: 555967 - DNA, 513 bp, Homo sapiens
  misc_feature: HIJSMM301CUO4Y.48.66.F11.1.454.light.4.raw
agtatacatacacgaccggtgctcgatttagtcacgcgagaaagggaagcctgagaacacttagccttcatgagtgtccccaccatggcctggatgatgcttctcctcggactccttgcttatggatcaggcgtgcattctcagagtgtggtgacccaggaaccatcgttctcagtgtcccctggagggacagtcacactcacttgtggcttgacttctggctcagtcgcgccggtccactaccccagttggtaccaacagatcccaggccaggctccacgcacgctcatcttcatgaaacagattcgctcttctggggtccctgatcggttttctggctccatcgttgggggcaaagccgccctcaccatcacgggggcccagggcagaggatgaggcgaattattattgtatgctccacaggggcaggggcacctggggagttcggcggcggggaccaagctgaccgtcctaggtcagcccaaggctgccccctcggtcactctgttccca

SEQ ID NO: 555968 - DNA, 447 bp, Homo sapiens
  misc_feature: HIJSMM301D9D9L.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaagtccaacccctctgtcactctgttcccgccctcctccatactcgta

SEQ ID NO: 555969 - DNA, 484 bp, Homo sapiens; identical to SEQ ID NO: 535400
  misc_feature: HIJSMM301A2OGO.46.26.C04.1.454.light.4.raw

SEQ ID NO: 555970 - DNA, 486 bp, Homo sapiens; identical to SEQ ID NO: 535043
  misc_feature: HIJSMM301E2DXO.46.35.D02.1.454.light.4.raw

SEQ ID NO: 555971 - DNA, 509 bp, Homo sapiens; identical to SEQ ID NO: 539269
  misc_feature: HIJSMM301EBHH2.4.57.F02.1.454.light.4.raw

SEQ ID NO: 555972 - DNA, 444 bp, Homo sapiens; identical to SEQ ID NO: 534993
  misc_feature: HIJSMM301CQCGI.5.9.A09.1.454.light.4.raw

SEQ ID NO: 555973 - DNA, 492 bp, Homo sapiens; identical to SEQ ID NO: 534967
  misc_feature: HIJSMM301EESQ6.47.64.F09.1.454.light.4.raw

SEQ ID NO: 555974 - DNA, 460 bp, Homo sapiens; identical to SEQ ID NO: 536053
  misc_feature: HIJSMM301DMQ8W.22.28.C06.1.454.light.4.raw

SEQ ID NO: 555975 - DNA, 519 bp, Homo sapiens; identical to SEQ ID NO: 539821
  misc_feature: HIJSMM301BC8A2.7.86.H09.1.454.light.4.raw

SEQ ID NO: 555976 - DNA, 486 bp, Homo sapiens; identical to SEQ ID NO: 535043
  misc_feature: HIJSMM301BKV02.46.35.D02.1.454.light.4.raw

SEQ ID NO: 555977 - DNA, 494 bp, Homo sapiens; identical to SEQ ID NO: 534994
  misc_feature: HIJSMM301BVXU1.27.78.H01.1.454.light.4.raw

SEQ ID NO: 555978 - DNA, 498 bp, Homo sapiens; identical to SEQ ID NO: 544837
  misc_feature: HIJSMM301AND4L.11.71.G05.1.454.light.4.raw

SEQ ID NO: 555979 - DNA, 478 bp, Homo sapiens
  misc_feature: HIJSMM301DTRW8.48.57.F02.1.454.light.4.raw
agtatacatacacgaccggtgctcgatttagctcgatatagttgggtttgggggcagcttctcttcctcctgctactctggctcccagataccaccggagcacttgtgttgacgcagtctccaggcaccctgtctttgtctccaggggagagagccaccctctcctgcagggccagtcagagtgttagcggcggctccgtagcctggtaccagcagaaacgtggccaggttcccaggctcctcatctatgatgcatccagcagggccactggcatcccagacaggttcagtggcagtgggtctgggatagacttcactctcaccatcagcagactggagcctgaagattttgcagtgtattactgtcagcagtatggtagctcacctcaactcactttcggcggagggaccaaggtggagatcaaacgaactgtggctgcaccatctgtcttcatcttcccgccatctgatatgtata

SEQ ID NO: 555980 - DNA, 506 bp, Homo sapiens; identical to SEQ ID NO: 537290
  misc_feature: HIJSMM301AY2KM.13.11.A11.1.454.light.4.raw

SEQ ID NO: 555981 - DNA, 478 bp, Homo sapiens; identical to SEQ ID NO: 535129
  misc_feature: HIJSMM301DRCPW.11.11.A11.1.454.light.4.raw

SEQ ID NO: 555982 - DNA, 504 bp, Homo sapiens; identical to SEQ ID NO: 539083
  misc_feature: HIJSMM301ALA7Q.8.19.B08.1.454.light.4.raw

SEQ ID NO: 555983 - DNA, 496 bp, Homo sapiens
  misc_feature: HIJSMM301AP2N1.12.38.D05.1.454.light.4.raw
atacgacgtacacgaccggtgctcgatttagtatctgatagttgggtttgggggaactgctcagttaggacccagacggaaccatggaagccccagcgcagcttctcttcctcctgctactctggctcccagattcctctggagaagttgtgatgacgcagtctccagccaccctgtctgcgtctccaggggaaagagtcaccctctcatgcagggccagtgagattgttaccaccaacttagcctggtaccaacagaaacctggccagcctcccaggctcctcatttatggtgcatccacaagggccgctggtgtcccagccaggttcagtggcagtggatctgcgacagagttcactctcaccgtcagcagcctgcagtctgaagattttgcagtttattactgtcagcagtatgagaagtggttcaagactttcggcggagggaccgaaggtggagatacaacgaactagtggctgcaccatctgtcttcatt

SEQ ID NO: 555984 - DNA, 499 bp, Homo sapiens
  misc_feature: HIJSMM301B2WR9.43.34.D01.1.454.light.4.raw
tgtgagtagtcacgaccggtgctcgatttagatcgtctgtgttgggtttgggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacacggtcaccgtcctaggtcagcccaaggccaaccccta

SEQ ID NO: 555985 - DNA, 473 bp, Homo sapiens
  misc_feature: HIJSMM301BQM7F.3.38.D05.1.454.light.4.raw
agacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactacccctctcactttcggcgggggccgaacggtggagatcaaacgaa

SEQ ID NO: 555986 - DNA, 488 bp, Homo sapiens; identical to SEQ ID NO: 542699
  misc_feature: HIJSMM301AH6XI.12.51.E07.1.454.light.4.raw

SEQ ID NO: 555987 - DNA, 497 bp, Homo sapiens; identical to SEQ ID NO: 542419
  misc_feature: HIJSMM301BSKJN.22.14.B03.1.454.light.4.raw

SEQ ID NO: 555988 - DNA, 518 bp, Homo sapiens
  misc_feature: HIJSMM301BIB1U.9.2.A02.1.454.light.4.raw
  modified_base (514)..(514): a, c, t, g, unknown or other
tgatacgtctcacgaccggtgctcgatttagactcatctacaggggggggtcgtcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacgaatagcgacattggtggctctaatcatgtctcctggtactataacagtccaggcaaagcccccaaactcataatttatgatgtctttagacggccctcagggatttcttctcggttgtctggctccaagtctgggaacacggcctccctgaccatctctggacttcagcctgaggacgagggtgattacttctgcagttcagattcagaaacttcccctcgttgggtgttcggcggagggaccatgctgaccgtcctgagtcagcccaaggctgccccctcggtcactctgttcccnccct

SEQ ID NO: 555989 - DNA, 444 bp, Homo sapiens; identical to SEQ ID NO: 535594
  misc_feature: HIJSMM301AH87W.9.9.A09.1.454.light.4.raw

SEQ ID NO: 555990 - DNA, 514 bp, Homo sapiens
  misc_feature: HIJSMM301D74QI.10.26.C04.1.454.light.4.raw
catagtagtgcacgaccggtgctcgattagtctagcgactttgggtttgggggctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaaggaccaaggtggcaatcaaccgaactgtggctgcaccatctgtcttcatcttcccgcc

SEQ ID NO: 555991 - DNA, 498 bp, Homo sapiens
  misc_feature: HIJSMM301A72FQ.52.34.D01.1.454.light.4.raw
cgcagtacgacacgaccggtgctcgatttagatcgtctgtgttgggtttggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtattagcaactacttagcctggtaccaacagaaacctggccaggctcccaggctcctcatctatgatgcgtccaacagggccactggcatcccagccaggttcagtggcggtgggtctgggacagacttcactctcaccatcagcagcctagagcctgaagattttgcagtttattactgtcagcagcgtagcaactggcctccgatcaccttcggccaagggacacgactggagattaaacgaactgtggctgcaccatctgtcttcat

SEQ ID NO: 555992 - DNA, 495 bp, Homo sapiens
  misc_feature: HIJSMM301A44LK.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccctcggtcactctgttcccaccctctcgagtgcgtct

SEQ ID NO: 555993 - DNA, 491 bp, Homo sapiens; identical to SEQ ID NO: 535294
  misc_feature: HIJSMM301BXEEI.16.68.G02.1.454.light.4.raw

SEQ ID NO: 555994 - DNA, 486 bp, Homo sapiens; identical to SEQ ID NO: 535043
  misc_feature: HIJSMM301DR4ZT.46.35.D02.1.454.light.4.raw

SEQ ID NO: 555995 - DNA, 515 bp, Homo sapiens; identical to SEQ ID NO: 538805
  misc_feature: HIJSMM301C9BJ2.14.19.B08.1.454.light.4.raw

SEQ ID NO: 555996 - DNA, 515 bp, Homo sapiens
  misc_feature: HIJSMM301BAH6A.16.1.A01.1.454.light.4.raw
tgtactactccacgaccggtgctcgatttagacgtctcatcaggggggggtcgtcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaccaagctgaccgtcctaggtcagcccaaggctgccccctcggtcactctgttccccg

SEQ ID NO: 555997 - DNA, 494 bp, Homo sapiens; identical to SEQ ID NO: 534994
  misc_feature: HIJSMM301AGA4K.27.78.H01.1.454.light.4.raw

SEQ ID NO: 555998 - DNA, 504 bp, Homo sapiens; identical to SEQ ID NO: 535495
  misc_feature: HIJSMM301CXM2Z.14.86.H09.1.454.light.4.raw

SEQ ID NO: 555999 - DNA, 490 bp, Homo sapiens; identical to SEQ ID NO: 536481
  misc_feature: HIJSMM301D3IEG.13.46.E02.1.454.light.4.raw

SEQ ID NO: 556000 - DNA, 514 bp, Homo sapiens
  misc_feature: HIJSMM301E3CPD.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggtccctcgggaccgaaacgtaggagtattcaaacgaaactagtggctgcaccaatctgtt

SEQ ID NO: 556001 - DNA, 483 bp, Homo sapiens; identical to SEQ ID NO: 535013
  misc_feature: HIJSMM301DOXT4.11.76.G10.1.454.light.4.raw

SEQ ID NO: 556002 - DNA, 475 bp, Homo sapiens
  misc_feature: HIJSMM301A9NUD.13.4.A04.1.454.light.4.raw
  modified_base (360)..(360): a, c, t, g, unknown or other
  modified_base (383)..(383): a, c, t, g, unknown or other
tcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacaggggtcccatcaaggttcagtggaagtggatctgggacagattttactttntaccatcagcagcctgcagcctnaagatattgcaacatattacttgtcagcagtatgataaatctcccgactcaccttcggtccaacgggacgacgactggagattaacgtaaac

SEQ ID NO: 556003 - DNA, 513 bp, Homo sapiens; identical to SEQ ID NO: 535244
  misc_feature: HIJSMM301BQ5J2.17.33.C11.1.454.light.4.raw

SEQ ID NO: 556004 - DNA, 486 bp, Homo sapiens
  misc_feature: HIJSMM301EPBMX.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccacctggcatcccaggcagattcagtggcagtgggtctgggacagacttcactctcaccatcagcagactggagcctgaagattttgcagtctattactgtcagcagtatggtcacgtcccaagaactttggccaggggaccaagctggagatcaaacgaactgtggctgcaccat

SEQ ID NO: 556005 - DNA, 484 bp, Homo sapiens; identical to SEQ ID NO: 535441
  misc_feature: HIJSMM301D4H9Y.26.60.F05.1.454.light.4.raw

SEQ ID NO: 556006 - DNA, 521 bp, Homo sapiens; identical to SEQ ID NO: 539470
  misc_feature: HIJSMM301C7RA4.27.23.C01.1.454.light.4.raw

SEQ ID NO: 556007 - DNA, 493 bp, Homo sapiens; identical to SEQ ID NO: 544666
  misc_feature: HIJSMM301DG59F.12.23.C01.1.454.light.4.raw

SEQ ID NO: 556008 - DNA, 513 bp, Homo sapiens; identical to SEQ ID NO: 543780
  misc_feature: HIJSMM301BYXRF.17.33.C11.1.454.light.4.raw

SEQ ID NO: 556009 - DNA, 504 bp, Homo sapiens
  misc_feature: HIJSMM301AN0XE.9.71.G05.1.454.light.4.raw
tgatacgtctcacgaccggtgctcgatttagtgtcgtcgcaagagagagggggggggtcgacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcggagggaccaggctgaccgtcctgagtcagcccaaggctgcccccc

SEQ ID NO: 556010 - DNA, 516 bp, Homo sapiens
  misc_feature: HIJSMM301B0BV0.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaacggcccccaaactcctcatctataggaataatcagcggccctcaggggtccctgaccgattctctggctccaaggctggcacctcagcctccctggccatcagtgggctccggtccgaggatgaggctgattattactgtgcagcatgggatgacagcctgagtggtccttgggtgttcggcggagggaccaagctgaccgtcctaagtcagcccaaggctgccccctcggtcactctgttccccaccctcctcg

SEQ ID NO: 556011 - DNA, 511 bp, Homo sapiens
  misc_feature: HIJSMM301CX59G.48.34.D01.1.454.light.4.raw
agtatacatacacgaccggtgctcgatttagatcgtctgtgttgggtttgggggctgtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctgttccccg

SEQ ID NO: 556012 - DNA, 483 bp, Homo sapiens; identical to SEQ ID NO: 536526
  misc_feature: HIJSMM301A3LF0.10.3.A03.1.454.light.4.raw

SEQ ID NO: 556013 - DNA, 479 bp, Homo sapiens; identical to SEQ ID NO: 535665
  misc_feature: HIJSMM301A7S9O.12.10.A10.1.454.light.4.raw

SEQ ID NO: 556014 - DNA, 507 bp, Homo sapiens
  misc_feature: HIJSMM301D3JVG.49.38.D05.1.454.light.4.raw
agtcgagagacacgaccggtgctcgatttagtatctgatagttgggtttgggggctgtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgccaaaaagatatgcttattggtaccatcagaagtcaggccaggcccctgtactggtcatctatgaggacaccaaacgaccctccgggatccctacgagattctctggctccagtttagggacagtggccaccctgacagtcagtggggcccaggtggaggatgagggtgattactactgttactcaacagacattactactactcatagggtgttcggcggagggaccaagctgaccgtcctaggtcagcccaaggctgccccctcggtcactctgtt

SEQ ID NO: 556015 - DNA, 500 bp, Homo sapiens
  misc_feature: HIJSMM301AJVXY.21.38.D05.1.454.light.4.raw
tcgtcgctcgcacgaccggtgctcgatttagtatctgatagttgggtttggggggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaagagttactctctcctgcaaggccagtcagagtgttggcatcgacgttgcctggtaccaacaaaaacctggccaggctcccagtctcctcatctatggggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggccaggggaccaaggtggagatcagacgaactgtggctgcaccatctgtcttcatt

SEQ ID NO: 556016 - DNA, 525 bp, Homo sapiens
  misc_feature: HIJSMM301AEQ4C.22.27.C05.1.454.light.4.raw
acatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagttttattactgtcagcaatattatacttcctcctcagtacgttcggaccgaacgggaaccgaagggtaggaaacgtacgaaaacgaaccgtagtcggtcgtcggcaccacttcg

SEQ ID NO: 556017 - DNA, 480 bp, Homo sapiens
  misc_feature: HIJSMM301A45RS.11.17.B06.1.454.light.4.raw
cgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccgggcaagtcagatcattagcagctatttaaattggtatcagcagaaaccagggaaagcccctgaggtcctgatctatgctgcatccagtttgcagagtggggtcccatcaaggttcagtggcagtggatctgcgacagatttcactctcaccatcagcagtctgcaacctgaagattttgcaacttactactgtcaacagagttacagtaccccgtggacgttcggccgaaggaccaaggtaggaaatacaaacgaaactgtggctgca

SEQ ID NO: 556018 - DNA, 486 bp, Homo sapiens; identical to SEQ ID NO: 535043
  misc_feature: HIJSMM301CWU0J.46.35.D02.1.454.light.4.raw

SEQ ID NO: 556019 - DNA, 504 bp, Homo sapiens
  misc_feature: HIJSMM301CME9D.10.39.D06.1.454.light.4.raw
catagtagtgcacgaccggtgctcgatttagtgacatctcgcagttctttggggctgggcctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctgtggttgtcgtctataatgataacgaccggccctcagggatccctgagcgattctctggctccaattcgggcaacacggccaccctcatcatcaccagggtcgaggccggggatgaggccgactactactgtcaggtgtgggatttcactactgatcatgtgggggtcttcggcggagggaccaagctgaccgtcctaagtcagcccaaggctgccccctggtccta

SEQ ID NO: 556020 - DNA, 496 bp, Homo sapiens; identical to SEQ ID NO: 536248
  misc_feature: HIJSMM301CSQ27.22.27.C05.1.454.light.4.raw

SEQ ID NO: 556021 - DNA, 483 bp, Homo sapiens
  misc_feature: HIJSMM301BEUTV.13.56.F01.1.454.light.4.raw
tcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccaggggaaagagccaccctctcctgcagggccagtcagacagttagcaacaacgtagcctggtaccagcagaaacgtggccaggctcccaggctcctcatctatggtgcatccaccagggccactggtatcccagaccggttcagtggcagtgggtctgggacagacttcactctcaccatcagcagtctgcagtctgaagattttgcagtttattactgtcagcagtataataactggcctcgtacatgtacacttttggccagggaccaacctggagat

SEQ ID NO: 556022 - DNA, 494 bp, Homo sapiens; identical to SEQ ID NO: 534992
  misc_feature: HIJSMM301BM61M.9.1.A01.1.454.light.4.raw

SEQ ID NO: 556023 - DNA, 464 bp, Homo sapiens; identical to SEQ ID NO: 537214
  misc_feature: HIJSMM301DLG21.18.59.F04.1.454.light.4.raw

SEQ ID NO: 556024 - DNA, 515 bp, Homo sapiens
  misc_feature: HIJSMM301CU0TX.13.38.D05.1.454.light.4.raw
tcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgtcggtccacggacgaacggtaggaaagtacgaagcgaacctagtggtcgtgtcgaccactctgtcttctactcttcccgt

SEQ ID NO: 556025 - DNA, 514 bp, Homo sapiens
  misc_feature: HIJSMM301B126Z.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccgggggccactttcggccctcgggaccgaaagtaggataatcaaacgaaactgtggctgcaccaatctgtcttcta

SEQ ID NO: 556026 - DNA, 501 bp, Homo sapiens; identical to SEQ ID NO: 548357
  misc_feature: HIJSMM301EG7R8.19.67.G01.1.454.light.4.raw

SEQ ID NO: 556027 - DNA, 519 bp, Homo sapiens
  misc_feature: HIJSMM301C6430.16.66.F11.1.454.light.4.raw
tgtactactccacgaccggtgctcgatttagtcacgcgagaagggtgagaagtagtggagcctggagcatccccactatggcctgggctccactacttctcaccctcctcgctcactgcacaggttcttgggccaattttctactgactcagccccactctgtgtcggagtctccggggaagacggtaaccatctcctgcacccgcagcagtggcacctttgccggctattatgtgcagtggttccagcagcgcccgggcagtgcccccacagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtgttcggcggagggaccaagctggccgtcctaggtcagcccaaggctgccccctcggtcactctgttcccaccctcctcgatagtaca

SEQ ID NO: 556028 - DNA, 490 bp, Homo sapiens; identical to SEQ ID NO: 535420
  misc_feature: HIJSMM301CNKJA.3.72.G06.1.454.light.4.raw

SEQ ID NO: 556029 - DNA, 477 bp, Homo sapiens
  misc_feature: HIJSMM301C9YT5.40.1.A01.1.454.light.4.raw
  modified_base (418)..(418): a, c, t, g, unknown or other
tctagcgactcacgaccggtgctcgatttagacgtctcatcaggggggagtcagtcccaaccaggacacagcatggacatgagggtccctgctcagctcctggggctcctgctgctctggctctcaggtgccagatgtgacatccagctgacccagtctccatcctccctgtctgcatctgttggagacagagtcaccatcacttgccaggcgagtcaggacattagtaaatatttgaattggtatcaacaaaaaccagggaaagcccctaagctcctgatctacgatgcatctaagttggaaacaggggtctcatcaaggttcagtggaagtggatctgggacagatcctactttcaccatcagcagcctgcagccagaagatattgcgacatatttctgtcaggtgtatgaaagtntccctgtttttggtccaggggaccaaggtggagatcaaacgaaactgtggctgcaccat

SEQ ID NO: 556030 - DNA, 492 bp, Homo sapiens; identical to SEQ ID NO: 550582
  misc_feature: HIJSMM301C1CWO.10.72.G06.1.454.light.4.raw

SEQ ID NO: 556031 - DNA, 492 bp, Homo sapiens
  misc_feature: HIJSMM301CH01M.48.37.D04.1.454.light.4.raw
agtatacatacacgaccggtgctcgatttagtagcatactgttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaataactcgcacgcaagtactgttcggcggagggaccaagctgacagtcctaggtcagcccaaggctgccccccg

SEQ ID NO: 556032 - DNA, 472 bp, Homo sapiens; identical to SEQ ID NO: 538929
  misc_feature: HIJSMM301D1LTE.12.1.A01.1.454.light.4.raw

SEQ ID NO: 556033 - DNA, 491 bp, Homo sapiens; identical to SEQ ID NO: 535294
  misc_feature: HIJSMM301B3OC8.16.68.G02.1.454.light.4.raw

SEQ ID NO: 556034 - DNA, 489 bp, Homo sapiens
  misc_feature: HIJSMM301BN604.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaggcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaggcggagatcagacgaactgtggctgcaccatctgtcttcta

SEQ ID NO: 556035 - DNA, 488 bp, Homo sapiens; identical to SEQ ID NO: 539884
  misc_feature: HIJSMM301CPM63.7.85.H08.1.454.light.4.raw

SEQ ID NO: 556036 - DNA, 499 bp, Homo sapiens; identical to SEQ ID NO: 542463
  misc_feature: HIJSMM301EOL95.26.26.C04.1.454.light.4.raw

SEQ ID NO: 556037 - DNA, 496 bp, Homo sapiens
  misc_feature: HIJSMM301AHCD9.41.38.D05.1.454.light.4.raw
tctatactatcacgaccggtgctcgatttagtatctgatagttgggtttggggggagccagacccagtcaggacacagcatggacatgagggtccccgctcagctcctggggctcctgctgctctggttcccaggttccagatgcgacatccagatgacccagtctccatcttctgtgtctgcatctgtcggagacagagtcaccatcacttgtcgggcgagtcagggtattggcagctacttagtctggtatcaacaaaaaccagggaaagcccctaaactccttatttatggatcatccagtttacaaagtggggtcccatcaaggttcagcggcagtggatctgggacacatttcactctcactatcagcagcctgcagcctgaggattttgcgacttactattgtcaacaggctgacagtttccctctcactttcggcggagggaccaaggttgagaccaaacgaactgtggctgcaccatctgtcttcatt

SEQ ID NO: 556038 - DNA, 521 bp, Homo sapiens; identical to SEQ ID NO: 538715
  misc_feature: HIJSMM301DHRYZ.27.23.C01.1.454.light.4.raw

SEQ ID NO: 556039 - DNA, 510 bp, Homo sapiens; identical to SEQ ID NO: 535855
  misc_feature: HIJSMM301D7CMT.17.33.C11.1.454.light.4.raw

SEQ ID NO: 556040 - DNA, 447 bp, Homo sapiens; identical to SEQ ID NO: 535201
  misc_feature: HIJSMM301B9I1H.18.9.A09.1.454.light.4.raw

SEQ ID NO: 556041 - DNA, 503 bp, Homo sapiens; identical to SEQ ID NO: 536834
  misc_feature: HIJSMM301DYBAE.2.35.D02.1.454.light.4.raw

SEQ ID NO: 556042 - DNA, 502 bp, Homo sapiens; identical to SEQ ID NO: 536604
  misc_feature: HIJSMM301E1T0P.27.78.H01.1.454.light.4.raw

SEQ ID NO: 556043 - DNA, 499 bp, Homo sapiens
  misc_feature: HIJSMM301ED1FB.19.71.G05.1.454.light.4.raw
tactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgttggacgttcggccaagggaccaaaggtggataatcagacgaactagtggctgca

SEQ ID NO: 556044 - DNA, 489 bp, Homo sapiens; identical to SEQ ID NO: 535139
  misc_feature: HIJSMM301CN9W4.14.55.E11.1.454.light.4.raw

SEQ ID NO: 556045 - DNA, 487 bp, Homo sapiens; identical to SEQ ID NO: 536196
  misc_feature: HIJSMM301CMQD7.11.28.C06.1.454.light.4.raw

SEQ ID NO: 556046 - DNA, 519 bp, Homo sapiens
  misc_feature: HIJSMM301A1D80.18.26.C04.1.454.light.4.raw
tacgagtatgcacgaccggtgctcgatttagtctagcgactttggggtttgggggggtcgagacccacgtcgggacgacagcatggacatgagggtccccggcctcagctcctggggcgtcctgctgctctggttcccacggttccagatgcgacatccagatgacccagtctccatcttccgtggctgcctctgtaggagacagagtcagcatcacttgtcggacgagtcaacatattagctggttaatttggtatcagcagaaagcaggaaaagcccctaacctcctgatcaagggtccgtccagtttccagagtggggcctcaacaaggttcagcggcagtggatctggggacagatttcactctcaccatcaccagcctgcagcctgaagattttgcaacttactattgtcaacaggctgacaggttcccgctgactttcggcggagggaccgaacggtaggagatcaaaggaactagtggcgtcgcaccatctgtcttcatctttcccgcccta

SEQ ID NO: 556047 - DNA, 501 bp, Homo sapiens
  misc_feature: HIJSMM301A9XO9.49.29.C07.1.454.light.4.raw
agtcgagagacacgaccggtgctcgatttagagtgctacgaagggaaagggggtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggcaaaacaatatggatattggtaccggcagaagccaggccaggcccctgtgttggtaatatataaagacagggagaggcccccagggatccctgagcgatactctggctccagctcagggacaacagtcacattgaccatcagtggagtccaggcagaagacgaggctgactattactgtcaatctgcggacagcagtggttctcatgtggtattcggcggagggaccaagctgaccgtcctaggtcagcccaaggctgccccctggtcactctcg

SEQ ID NO: 556048 - DNA, 507 bp, Homo sapiens
  misc_feature: HIJSMM301ENJRO.48.28.C06.1.454.light.4.raw
agtatacatacacgaccggtgctcgatttagagctcacgtattgggtttgggggctgtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctgtt

SEQ ID NO: 556049 - DNA, 515 bp, Homo sapiens
  misc_feature: HIJSMM301AJKLI.11.67.G01.1.454.light.4.raw
cgagagataccacgaccggtgctcgatttagagtatacatattgggtttgggggggttggagaagacaggactcaggacaatctccagcatggccagcttccctctcctcctcaccctcctcactcactgtgcagggtccgtgggcccgacgtctgttctgactcagccaccctcagcgtctgggacccccgggccagagaatcaccatctcttgtactggaagcagctccaatatcggaagtaacgatgtcaattggtatcaacatctccccggtacggcccccaaacctcctcatctataggaatagccagcggccctcaggggtccctggccgattctctggctcgaagtctggcacctcagcctccctggcctgcagtgggctccagtctgaggatgaggctgactattattgtgcagcgtggggatgacggtctgagtgctgtggtcttcggcggagggaccgaagctgaccgtccctgggtcagcccaaggctgccccctcggtcactc

SEQ ID NO: 556050 - DNA, 498 bp, Homo sapiens
  misc_feature: HIJSMM301AFMJ9.14.53.E09.1.454.light.4.raw
cgtctagtaccacgaccggtgctcgatttagagagagtgtgttgggtttgggggggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgcttttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttatcgggtgttcggtcggagggaccaagctgaccgtcctaggtcagcccaaggctgccccctccggtcc

SEQ ID NO: 556051 - DNA, 489 bp, Homo sapiens; identical to SEQ ID NO: 543840
  misc_feature: HIJSMM301EF6Q3.12.88.H11.1.454.light.4.raw

SEQ ID NO: 556052 - DNA, 441 bp, Homo sapiens; identical to SEQ ID NO: 546257
  misc_feature: HIJSMM301BAJY7.41.9.A09.1.454.light.4.raw

SEQ ID NO: 556053 - DNA, 503 bp, Homo sapiens; identical to SEQ ID NO: 536834
  misc_feature: HIJSMM301CQPA0.2.35.D02.1.454.light.4.raw

SEQ ID NO: 556054 - DNA, 505 bp, Homo sapiens; identical to SEQ ID NO: 539292
  misc_feature: HIJSMM301CTZEO.19.85.H08.1.454.light.4.raw

SEQ ID NO: 556055 - DNA, 488 bp, Homo sapiens
  misc_feature: HIJSMM301BC5W6.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgttggacgttcggccaagggaccaaggtaggatatcagacgaa

SEQ ID NO: 556056 - DNA, 508 bp, Homo sapiens
  misc_feature: HIJSMM301CTW9F.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtctaggtcagcccaaggctgccccctcggtcactctgtt

SEQ ID NO: 556057 - DNA, 444 bp, Homo sapiens
  misc_feature: HIJSMM301BF5CT.9.9.A09.1.454.light.4.raw
tgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaacccctcatctatggtaatagtaatcggccctcaggggtccctgaccgattctctggctccaagtctggcacctcagtctccctggccatcactgggcttcaggctgaggatgaggctgattattactgccactcctatgacagcagcctgagaagtgtggtattcggcggagggaccaagctgaccgtcctaggtcagcccaaggctgccccctcggtcactctgttcccaccctcctcagacgtatca

SEQ ID NO: 556058 - DNA, 498 bp, Homo sapiens; identical to SEQ ID NO: 537020
  misc_feature: HIJSMM301EBWGO.26.26.C04.1.454.light.4.raw

SEQ ID NO: 556059 - DNA, 500 bp, Homo sapiens; identical to SEQ ID NO: 539012
  misc_feature: HIJSMM301EGEDC.48.36.D03.1.454.light.4.raw

SEQ ID NO: 556060 - DNA, 517 bp, Homo sapiens
  misc_feature: HIJSMM301AHF42.53.65.F10.1.454.light.4.raw
cgcgtatacacacgaccggtgctcgatttagctacgctctaaggggctgtctgggcctaaggaagcagcactggtggtgcctcagccatggcctggaccgttctcctcctcggcctcctctctcactgcacagactctgtgacctcctatgtgctgactcagccaacctcggtgtcagtggccccaggacagacggccagcattacctgtgggggaaaccacattggagctaaaaatgtgcactggtaccagcagaagccaggccaggcccctgtgctggtcgtctataatggaagcggccggccctcatggatccctgggcgattctctggctccaagtctgggaacacggccaccctaaccatcagcagggtcgaagccggggatgaggccgactattactgtcaggtgtgggataatagtaatggtgggaattgggtgttcggcggagggaccaagctgaccgtcctaggtcagcccaaggctgccccctcggtcactctgttcccaccctcct

SEQ ID NO: 556061 - DNA, 523 bp, Homo sapiens
  misc_feature: HIJSMM301BU7C1.27.23.C01.1.454.light.4.raw
agcgtcgtctcacgaccggtgctcgatttagtacacgtgattagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtcccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccgccct

SEQ ID NO: 556062 - DNA, 447 bp, Homo sapiens; identical to SEQ ID NO: 535882
  misc_feature: HIJSMM301BKLU7.18.9.A09.1.454.light.4.raw
  modified_base (429)..(429): a, c, t, g, unknown or other

SEQ ID NO: 556063 - DNA, 504 bp, Homo sapiens
  misc_feature: HIJSMM301B34OO.26.80.H03.1.454.light.4.raw
agactatactcacgaccggtgctcgatttagctgtgcgtcgaagggaaagggactgactaccacctgcaggtcagggccaaggttatggggtcccaggttcacctcctcagcttcctcctcctttggatctctgagccgacactcacgcagtctccagcattcatgtcagcgactctaggagacaaggtcaacttctcctccaaagccagccaagacattgatgatgatatgaactggcaccaacacaaaccaggagaagctgctatttccattactcaagaaactaatggtctcctacctggaatgccacctcgactcagtggcaacaaatatggaacagtttttaccctcacaactcatatcacagaatctgaggatgctgcattttacttcggtctacaacatgataatttccctccgtggacgtcgtccgaaggaccgaagaggcaaatacaacgaaactagtggctgcaccactctgtcttcactcttcccgtcccact

SEQ ID NO: 556064 - DNA, 484 bp, Homo sapiens; identical to SEQ ID NO: 535211
  misc_feature: HIJSMM301B6WNG.47.46.E02.1.454.light.4.raw

SEQ ID NO: 556065 - DNA, 491 bp, Homo sapiens
  misc_feature: HIJSMM301AGME3.47.78.H01.1.454.light.4.raw
agctcacgtacacgaccggtgctcgatttagtgtgagtagtttgggtttggggtgatcaggactcctcagttcaccttctcacaatgaggctccctgctcagctcctggggctgctaatgctctgggtcccagatccagtggggatgttgtgatgactcagtctccactctccctgtccgtcacccttgcacagccggcctccatctcctgttggtctggtcaaggcctcgaatacagtgatggaaacacctgcttgaattgctttcaccagaggccaggcccatctccaaggcgcctaatttataagctttctaaccgggactctggggtcccagacagattcagcggcagtggcactgatgtcacactgacaatcagcagggtggaggctgaggatgttgggtttgttctccatgcaaggtacacactggccttttggccaggggaccaacctggagatcaaatgaactgtggctgcaccatctgtctt

SEQ ID NO: 556066 - DNA, 498 bp, Homo sapiens; identical to SEQ ID NO: 546411
  misc_feature: HIJSMM301B3P9F.48.59.F04.1.454.light.4.raw

SEQ ID NO: 556067 - DNA, 483 bp, Homo sapiens; identical to SEQ ID NO: 539682
  misc_feature: HIJSMM301EE8LZ.49.28.C06.1.454.light.4.raw

SEQ ID NO: 556068 - DNA, 501 bp, Homo sapiens; identical to SEQ ID NO: 555551
  misc_feature: HIJSMM301BGO7O.21.81.H04.1.454.light.4.raw

SEQ ID NO: 556069 - DNA, 507 bp, Homo sapiens; identical to SEQ ID NO: 538702
  misc_feature: HIJSMM301EU1SY.11.57.F02.1.454.light.4.raw

SEQ ID NO: 556070 - DNA, 383 bp, Homo sapiens; identical to SEQ ID NO: 447524
  misc_feature: HIJSMM301DWX85.41.26.C04.1.454.light.4.raw

SEQ ID NO: 556071 - DNA, 502 bp, Homo sapiens; identical to SEQ ID NO: 537816
  misc_feature: HIJSMM301DGDCW.19.78.H01.1.454.light.4.raw

SEQ ID NO: 556072 - DNA, 496 bp, Homo sapiens
  misc_feature: HIJSMM301AMH4G.12.38.D05.1.454.light.4.raw
atacgacgtacacgaccggtgctcgatttagtatctgatagttgggtttgggggaactgctcagttaggacccagacggaaccatggaagccccagcgcagcttctcttcctcctgctactctggctcccagattcctctggagaagttgtgatgacgcagtctccagccaccctgtctgcgtctccaggggaaagagtcaccctctcatgcagggccagtgagattgttaccaccaacttagcctggtaccaacagaaacctggccagcctcccaggctcctcatttatggtgcatccacaagggccgctggtgtcccagccaggttcagtggcagtggatctgcgacagagttcactctcaccgtcagcagcctgcagtctgaagattttgcagtttattactgtcagcagtatgagaagtggttcaagactttcggcggagggaccgaaggtggagatacaaacgaactgtggctgcaccatctgtcttcatt

SEQ ID NO: 556073 - DNA, 476 bp, Homo sapiens
  misc_feature: HIJSMM301EN2L8.7.81.H04.1.454.light.4.raw
  modified_base (461)..(461): a, c, t, g, unknown or other
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatccactttcgccctgggactgaagtgcatatgaanagaactgtggctgca

SEQ ID NO: 556074 - DNA, 493 bp, Homo sapiens
  misc_feature: HIJSMM301A09D0.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgcagtctgaagattttgcagtttattactgtcagcagtatgatacctggcctccgtacacttttgtccgggggaccaagctggaaatcaagcgaactgtggctgcaccatctgtcttcatt

SEQ ID NO: 556075 - DNA, 476 bp, Homo sapiens
  misc_feature: HIJSMM301D0FY8.5.15.B04.1.454.light.4.raw
atcagacacgcacgaccggtgctcgatttagacagtatatatccgcggggagtcagactcagtcaggacacagcatggacatgagggtccccgctcagctcctggggctcctgctgctctggctcccaggtgccaaatgtgacatccagatgacccagtctccttccaccctgtctgcatctataggagacagagtcaccatcacttgccgggccagtcagagtattagtaactggttggcctggtatcagcagaaaccaggcaaagccccaaagctccttatctctgatgcctccactttgcacggtggggtcccaccaacgttcagcggcagtggatctgggacagaattcactctcaccatcagcagcctgcagcctgatgatgctgcaacttattactgtcaacaatataacagttattggacgttcggccgaaggaccgaaggtggaaatcaaacgaactgtggctgcacc

SEQ ID NO: 556076 - DNA, 485 bp, Homo sapiens; identical to SEQ ID NO: 543370
  misc_feature: HIJSMM301DGMM0.3.10.A10.1.454.light.4.raw

SEQ ID NO: 556077 - DNA, 500 bp, Homo sapiens; identical to SEQ ID NO: 536183
  misc_feature: HIJSMM301D5EKZ.10.17.B06.1.454.light.4.raw

SEQ ID NO: 556078 - DNA, 505 bp, Homo sapiens
  misc_feature: HIJSMM301CFHCI.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggtccaaggaccgaaggtggaaagtcaaacgaactagtggctgcaccatctgtcttcatcttccccg

SEQ ID NO: 556079 - DNA, 508 bp, Homo sapiens
  misc_feature: HIJSMM301DNKZM.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcttcggccaagggaccgaaggtggaaatacaaacgaactagtggctgcaccactctcgtcttcctatcttccccg

SEQ ID NO: 556080 - DNA, 515 bp, Homo sapiens
  misc_feature: HIJSMM301B8DP3.49.37.D04.1.454.light.4.raw
agtcgagagacacgaccggtgctcgatttagtagcatactgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacataaacacttgggtgttcggcggcgggaccaaactgaccgtcctacgtcagccaaggctgccccctcggtcactctgttccca

SEQ ID NO: 556081 - DNA, 504 bp, Homo sapiens
  misc_feature: HIJSMM301CQJCN.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcacccatcaatagcctggaagctgaagatgctgcaacttattactgtcatcagagtactactttacctcaagtgatcaccttcggccaagggacacgactggagattaaacg

SEQ ID NO: 556082 - DNA, 404 bp, Homo sapiens; identical to SEQ ID NO: 535530
  misc_feature: HIJSMM301B5LJF.4.35.D02.1.454.light.4.raw

SEQ ID NO: 556083 - DNA, 487 bp, Homo sapiens; identical to SEQ ID NO: 546877
  misc_feature: HIJSMM301EHJMO.41.44.D11.1.454.light.4.raw

SEQ ID NO: 556084 - DNA, 495 bp, Homo sapiens
  misc_feature: HIJSMM301CI47S.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttacttctacatcagcagcctgcagcctgaagatattgcaacatattactgtcaacagtatcataatactccccaccttcgtccctcgggaccgaaacgtaggagtatacaactaaacgaagtgcgtgcacaactctgtt

SEQ ID NO: 556085 - DNA, 501 bp, Homo sapiens
  misc_feature: HIJSMM301EEVG5.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgacccatcactggggctcaggcggaagatgaggctgactattactgtaactcccgggccagcagtggtaacattgtgatattcggcggagggaccaaggtgaccgtcctacgtcagcccaaggctgccccctcggtccactcttccg

SEQ ID NO: 556086 - DNA, 479 bp, Homo sapiens
  misc_feature: HIJSMM301BUQDS.10.74.G08.1.454.light.4.raw
catagtagtgcacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaggagccaccctctcctgcagggccagtcagagtattagcagcaacttagcctggtaccagcagaaacctggccagtctcccaggctcctcctctatgatgcatccaccagggccactggtatcccagccaggttcagtggcagtgggtctgggacagagttcactctcaccatcagcagcctgcagtctgaggatattgctagtttattactgtcagcagtatactaactggcctctgacgttcggccaagggaccagggtggaaatcaaacgactgtggctgcaccat

SEQ ID NO: 556087 - DNA, 493 bp, Homo sapiens
  misc_feature: HIJSMM301D5C6S.27.78.H01.1.454.light.4.raw
agcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaacgaactgtggctgcaccatctgtt

SEQ ID NO: 556088 - DNA, 463 bp, Homo sapiens; identical to SEQ ID NO: 535062
  misc_feature: HIJSMM301B8SW9.11.73.G07.1.454.light.4.raw

SEQ ID NO: 556089 - DNA, 488 bp, Homo sapiens; identical to SEQ ID NO: 535081
  misc_feature: HIJSMM301EE67P.26.23.C01.1.454.light.4.raw

SEQ ID NO: 556090 - DNA, 509 bp, Homo sapiens
  misc_feature: HIJSMM301DP42H.40.16.B05.1.454.light.4.raw
tctagcgactcacgaccggtgctcgatttagagctcacgtaaggggggggtcgtcaggaggcagcactctcgggacgtctccaccatggcctgggctctgctcctcctcagcctcctcactcagggcacaggatcctggactcagtctgccctgactcagcctcgctcagtgtccgggtctcctggacagtcagtcaccctctcctgcactggaaccagcagtaatgttggtggttataactttgtctcctggtaccaacaccacccaggcaaagcccccaaattcttgatttatgatgtcaataagcggccctcaggggtccctgatcgcttctctggctccaagtctggcaacacggcctccctgaccatctctgggctccaggctgaggatgaggctgattattactgctgctcatttgctaggtagtttttgggtgttcggcggagggaccaagctgaccgtctaggtcagcccaaggctgccccctcggtcactctgttcccta

SEQ ID NO: 556091 - DNA, 496 bp, Homo sapiens; identical to SEQ ID NO: 535541
  misc_feature: HIJSMM301B91ET.3.33.C11.1.454.light.4.raw

SEQ ID NO: 556092 - DNA, 466 bp, Homo sapiens
  misc_feature: HIJSMM301D2X26.3.20.B09.1.454.light.4.raw
agacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcgtctatttaaattggtatcagcacaaaccagggaaagcccctaagctcctgatctatgctgaatccactttgcaaagtggggtcccatcaaggttcagtggcagtggatctgggacagatttcactctaaccatcagcggtctgcaacctgaagattttgcaactcactactgtcaacagagtgacagcagcctcacactttcggcggagggaccaaggtggagagtcaaacgaa

SEQ ID NO: 556093 - DNA, 495 bp, Homo sapiens
  misc_feature: HIJSMM301CTFIB.16.6.A06.1.454.light.4.raw
tgtactactccacgaccggtgctcgatttagatctactgacagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagcttggtaccagcagaaaccggggcagtctcctaagttgctcatttactgggcgtctacccgggaatccggggtccctgaccgattcagtggcagcgggtctgggacagatttcactctcaccatcagcagcctgcaggttgaagatgtggcagtttattactgtcagcagtattatactactcctctgacgttcggccaagggaccaaggtggaggatcaaacgaactgtggctgcaccat

SEQ ID NO: 556094 - DNA, 489 bp, Homo sapiens; identical to SEQ ID NO: 549642
  misc_feature: HIJSMM301A8OW9.52.70.G04.1.454.light.4.raw

SEQ ID NO: 556095 - DNA, 521 bp, Homo sapiens
  misc_feature: HIJSMM301BGVOV.27.23.C01.1.454.light.4.raw
agcgtcgtctcacgaccggtgctcgatttagtacacgtgattagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctcgttcccgccct

SEQ ID NO: 556096 - DNA, 496 bp, Homo sapiens
  misc_feature: HIJSMM301C2PE7.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcacccatcaatagcctggaagctgaagatgctgcaacttattactgtcatcagagtactactttacctcaagttgatcaccttcggccaagggacacgactggagattaaacgaactgtggctgcaccatctgtctt

SEQ ID NO: 556097 - DNA, 503 bp, Homo sapiens
  misc_feature: HIJSMM301ESCAU.51.5.A05.1.454.light.4.raw
cgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaagaaatctgctttttggtaccatcagaggccaggccaggcccctgtattggtcatctatgaggacaccaagcgaccctccggaatccctgagagagtcgctggctccaggtcagggacaatggccaccttgactatcactgggacccagatggacgatgaaggtgactaccactgttattcgacagacagcagtggtagtcagggggtcgttcggcggagggacgaagctgaccgtcctgagtcagcccaaggctgccccctcggtcactctgttccccg

SEQ ID NO: 556098 - DNA, 493 bp, Homo sapiens; identical to SEQ ID NO: 535770
  misc_feature: HIJSMM301DKBUB.51.71.G05.1.454.light.4.raw

SEQ ID NO: 556099 - DNA, 504 bp, Homo sapiens
  misc_feature: HIJSMM301BEEZH.10.71.G05.1.454.light.4.raw
catagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccgaaataagaggtcaaacgaactagtggctgcaccatctgtcttctat

SEQ ID NO: 556100 - DNA, 495 bp, Homo sapiens; identical to SEQ ID NO: 536055
  misc_feature: HIJSMM301AR182.47.38.D05.1.454.light.4.raw

SEQ ID NO: 556101 - DNA, 516 bp, Homo sapiens
  misc_feature: HIJSMM301C5OX1.19.85.H08.1.454.light.4.raw
tactctcgtgcacgaccggtgctcgatttagtatcactcagtcgcggggctccaaacagagcttcagcaagcataggtgggaatctgcaccatgccctgggctctgctcctcctgaccctcctcactcactctgcagtgtcagtggtccaggcaggactgactcagccaccctcggtggtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagtattttctacctccaggacacaaaatacagcctctctgaccattactggtctccagcctgacgacgaggctgactactactgctcagcctgggaccaccagcctcgctgcttggtcttttcggcgggagggaccgaagctcggaccgtccgtgggtcacgcccaaggctcgccccctccggt

SEQ ID NO: 556102 - DNA, 493 bp, Homo sapiens
  misc_feature: HIJSMM301B4U3P.52.38.D05.1.454.light.4.raw
cgcagtacgacacgaccggtgctcgatttagtatctgatagttgggttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtctgggtcagcccaaggccaacccactgtcact

SEQ ID NO: 556103 - DNA, 487 bp, Homo sapiens; identical to SEQ ID NO: 536536
  misc_feature: HIJSMM301BIAG8.26.45.E01.1.454.light.4.raw

SEQ ID NO: 556104 - DNA, 503 bp, Homo sapiens; identical to SEQ ID NO: 536834
  misc_feature: HIJSMM301D8SAF.2.35.D02.1.454.light.4.raw

SEQ ID NO: 556105 - DNA, 486 bp, Homo sapiens; identical to SEQ ID NO: 535385
  misc_feature: HIJSMM301DKE88.19.71.G05.1.454.light.4.raw

SEQ ID NO: 556106 - DNA, 497 bp, Homo sapiens; identical to SEQ ID NO: 542406
  misc_feature: HIJSMM301DLVFJ.9.53.E09.1.454.light.4.raw

SEQ ID NO: 556107 - DNA, 515 bp, Homo sapiens
  misc_feature: HIJSMM301A7E8G.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgtcgtccgacggaccgaaggtaggaaagtacaagacgaactacgtggtcgtgtcaccactctgttcttctactcttcccgt

SEQ ID NO: 556108 - DNA, 487 bp, Homo sapiens
  misc_feature: HIJSMM301DSUQ4.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggaaccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtgacgttcggccaagggaccaaggtggatatcagacgaa

SEQ ID NO: 556109 - DNA, 448 bp, Homo sapiens; identical to SEQ ID NO: 540364
  misc_feature: HIJSMM301CBW46.18.9.A09.1.454.light.4.raw

SEQ ID NO: 556110 - DNA, 493 bp, Homo sapiens
  misc_feature: HIJSMM301AR2RF.40.40.D07.1.454.light.4.raw
tctagcgactcacgaccggtgctcgatttagtgatagagcgtaacaacagaggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcgttatgaccttgtctcctggtaccaacaacacccaggcaaagcccccaaactcttgatttatgagatcactaagcggccctcaggcgtttctaatcgcttctctggctccaagtctggcaacacggcctccctgacaatctctgggctccaggctgaggacgaggctgattattattgctgctcatatgcaggtggtactacttgggtgttcggcagagggaccaagctgaccgtcctaggtcagcccaagg

SEQ ID NO: 556111 - DNA, 503 bp, Homo sapiens; identical to SEQ ID NO: 545379
  misc_feature: HIJSMM301EAS1B.9.53.E09.1.454.light.4.raw

SEQ ID NO: 556112 - DNA, 504 bp, Homo sapiens; identical to SEQ ID NO: 535128
  misc_feature: HIJSMM301DWKNC.19.85.H08.1.454.light.4.raw

SEQ ID NO: 556113 - DNA, 488 bp, Homo sapiens
  misc_feature: HIJSMM301EZ9DB.41.2.A02.1.454.light.4.raw
tctatactatcacgaccggtgctcgatttagactcatctacaggggagtcccaaccaggacacagcatggacatgagggtccctgctcagctcctggggctcctgctgctctggctctcaggcgccagatgtgacatccagatgacccagtctccatcctccctgtctgcatctttaggagacagagtcaccatctcttgtcaggcgaatgaggacattaacgtttatttaaattggtatcggcagagaccagggaaagcccctgagctcctgatttatgataaatcgaatttgaatccaggggtcccatctaggttccgtggaagtggatctgggacagactttactctcaccattagcagcctggagcctgaagatattgcaacatattactgtcaacagtctcatggtctcccccttagtttcggcggagggaccaaggttgagatcaaacgaactgtggctgcaccatctgtcttcatcttccg

SEQ ID NO: 556114 - DNA, 480 bp, Homo sapiens
  misc_feature: HIJSMM301CEX1F.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctcctggtcatcgctgggctccaggctgacgatgaggctgattattattgccagtcctatgacaacaccctgcgtggttttggctgttcggcggcgggacc

SEQ ID NO: 556115 - DNA, 488 bp, Homo sapiens; identical to SEQ ID NO: 537124
  misc_feature: HIJSMM301CFBOO.11.25.C03.1.454.light.4.raw

SEQ ID NO: 556116 - DNA, 506 bp, Homo sapiens
  misc_feature: HIJSMM301A70KA.17.87.H10.1.454.light.4.raw
cgtagactagcacgaccggtgctcgatttagcagtactgcgttgggtttgggggggtcgacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttgggggttataaccttgtctcctggtaccaacaccacccagacaaagcccccaaactcatcctttatgagggcactaagcggccctcaggggtttctaatcgcttcgctggctccacgtctggcagcacggcctccctgacaatctctgggctccaggctgaggacgaggctgattattacttgctgctcatattcaagtcgtgtcactatgatttttggcggtaggcaccaaggtgaccgtcctaggtcagccaaggctgccccctcggtc

SEQ ID NO: 556117 - DNA, 493 bp, Homo sapiens; identical to SEQ ID NO: 535745
  misc_feature: HIJSMM301APHMC.47.78.H01.1.454.light.4.raw

SEQ ID NO: 556118 - DNA, 484 bp, Homo sapiens; identical to SEQ ID NO: 535400
  misc_feature: HIJSMM301BOYF8.46.26.C04.1.454.light.4.raw

SEQ ID NO: 556119 - DNA, 499 bp, Homo sapiens; identical to SEQ ID NO: 536578
  misc_feature: HIJSMM301A9NO2.22.27.C05.1.454.light.4.raw

SEQ ID NO: 556120 - DNA, 505 bp, Homo sapiens
  misc_feature: HIJSMM301DVFWW.5.24.C02.1.454.light.4.raw
atcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggccaagctgaccgtcctaggtcagcccaaggctgtcccccg

SEQ ID NO: 556121 - DNA, 476 bp, Homo sapiens; identical to SEQ ID NO: 554798
  misc_feature: HIJSMM301EMPR1.48.2.A02.1.454.light.4.raw

SEQ ID NO: 556122 - DNA, 474 bp, Homo sapiens
  misc_feature: HIJSMM301DTF0U.13.76.G10.1.454.light.4.raw
tcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctggaactcagccactctgaccatcagcgggacccaggctatggatgaggctgactattactgtcaggcgtgggacagcagcactgcccgctatgtcttcggaactgggaccaaggtcaccgtctaagtcagaccc

SEQ ID NO: 556123 - DNA, 514 bp, Homo sapiens; identical to SEQ ID NO: 546238
  misc_feature: HIJSMM301CHEQR.47.85.H08.1.454.light.4.raw

SEQ ID NO: 556124 - DNA, 500 bp, Homo sapiens
  misc_feature: HIJSMM301BL0UT.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcaggtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccaagggaccaaggtggaaatacaaacgaactgtggctgcacc

SEQ ID NO: 556125 - DNA, 505 bp, Homo sapiens; identical to SEQ ID NO: 535503
  misc_feature: HIJSMM301DSAEM.8.28.C06.1.454.light.4.raw

SEQ ID NO: 556126 - DNA, 494 bp, Homo sapiens
  misc_feature: HIJSMM301BT11D.48.3.A03.1.454.light.4.raw
agtatacatacacgaccggtgctcgatttagagagcgtcacagggggagtcagacccagtcaggacacagcatggacatgagggtccccgctcagctcctggggctcctgctgctctggctcccaggtgccaagtgtgccatccagatgacccagtctccttccaccctgtctgcatctgtgggagacagcgtcaccatcacttgccgggccagtcagaatattaatgactggttggcctggtatcaacagaaaccagggaaagcccctaaacttctgatctttcaggcatctaatttagaacatggggtcccatcaaggttcagcggcagtgggtttggcacagacttcactctcaccatcgccagcctgcagcccgatgattttgcaacttatttctgccaacaatacaccactttgtggacgttcggccgggggacccgaaggtggagatcaagcgaactgtggctgcaccatctgtcttcatcttcccgt

SEQ ID NO: 556127 - DNA, 505 bp, Homo sapiens
  misc_feature: HIJSMM301BWSDV.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagcccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctcgggaccaaagtggatatcaaacgaactgtggctgcaccatctgt

SEQ ID NO: 556128 - DNA, 508 bp, Homo sapiens
  misc_feature: HIJSMM301BLPTD.17.28.C06.1.454.light.4.raw
cgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggcccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggctgcccccc

SEQ ID NO: 556129 - DNA, 488 bp, Homo sapiens
  misc_feature: HIJSMM301EQ3JC.3.12.B01.1.454.light.4.raw
agacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggctcccaggctcctcatctatgatgcatccaccagggccaccggtatcccagccaggttcagtggcagtgggtctgggacagagttcactctcaccatcagcagcctgcagtctgaggattttgcagtttattactgtcagcattacaataactggcctcggctcactttcggcggagggaccaaaggtggagatcaaacgaaactgtggctgcaccat

SEQ ID NO: 556130 - DNA, 501 bp, Homo sapiens
  misc_feature: HIJSMM301EREHO.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccaggatgaggctgactatactgtgcatcacgggacgcaacatgggatgacaatctgagcggttgggtgttcgggcggaggggaccaaactgaccgtccaggtcagcccaa

SEQ ID NO: 556131 - DNA, 516 bp, Homo sapiens
  misc_feature: HIJSMM301APHRM.47.87.H10.1.454.light.4.raw
agctcacgtacacgaccggtgctcgatttagcagtactgcgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctctgggatccccgagcgattctctggctccaagtctgggaacacggccaccctgaccgtcagcagggtcgacgtcggggatgaggccgtatatttttgtcaggtgtgggagactaatttggtcatatgttgttcggcggagggaccaagctgaccgtcctcggtcagcccaaggctgccccctcggtcactctgttcccaccctcct

SEQ ID NO: 556132 - DNA, 485 bp, Homo sapiens
  misc_feature: HIJSMM301EKIUL.13.48.E04.1.454.light.4.raw
tcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtggggtcccatcaaggttcagcggcagtggatctggcacagacttcattctcaccatcagcagcctgcagcctgaagattttgcaacttattactgtctacaagatcacaattatcctgggacgttcggccaacgggaaccgaaggtaggaaatacaaacgaactagtgg

SEQ ID NO: 556133 - DNA, 482 bp, Homo sapiens; identical to SEQ ID NO: 535920
  misc_feature: HIJSMM301BL4YI.19.71.G05.1.454.light.4.raw

SEQ ID NO: 556134 - DNA, 511 bp, Homo sapiens
  misc_feature: HIJSMM301D4ZKK.17.23.C01.1.454.light.4.raw
cgtagactagcacgaccggtgctcgatttagtacacgtgattagggattggggctgggcctaaggaagcagctctggtggtgcctcagccatggcctggaccgttctcctcctcggcctcctctctcactgcacaggctctgtggcctcctatgtgctgactcagccaccctcggtgtcagtggccccaggacagacggccacaattacctgcgggggaaggaacattggaagtaaaagtgtgcagtggtaccagcagaagccaggccaggcccctattctggtcgtctatgatgatagcgaccggccctcagggatccctgagcgattctctggctccaactctgacaacacggccaccctgaccatcagtagggtcggagccggggatgagggcgactattactgtcaggtgtgggatcacactagtgatcattatgtcttcggatcggggaccgaggtcaccgtcctaggtcagcccaaggccaaccccactgtcactctgttcccta

SEQ ID NO: 556135 - DNA, 505 bp, Homo sapiens; identical to SEQ ID NO: 535503
  misc_feature: HIJSMM301AXP98.8.28.C06.1.454.light.4.raw

SEQ ID NO: 556136 - DNA, 491 bp, Homo sapiens
  misc_feature: HIJSMM301DMGS9.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttcggtccgaagggaccgaacggtaggaaagtacaaacgaactagtggctgcacca

SEQ ID NO: 556137 - DNA, 521 bp, Homo sapiens; identical to SEQ ID NO: 538715
  misc_feature: HIJSMM301CL263.27.23.C01.1.454.light.4.raw

SEQ ID NO: 556138 - DNA, 474 bp, Homo sapiens; identical to SEQ ID NO: 546420
  misc_feature: HIJSMM301BSM8E.5.12.B01.1.454.light.4.raw

SEQ ID NO: 556139 - DNA, 579 bp, Homo sapiens
  misc_feature: HIJSMM301EVP7G.18.78.H01.1.454.light.4.raw
tacgagtatgcacgaccggtgctcgatttagtgtgagtagtttgggtttgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaaatcatgatttatgatgtcataatcggccctcaggggtttctaatcgcttctctggctccaagtctggcaacacggcctccctgaccatctctgggctccaggctgaggacgaggctgattattactgccagtcctatgtactaactaaggacggacgtgaaggtcgttaccgttactaaggttccttttccggggaaactttcgggtaccggaaaccggtaacggtacccgtaccccgttacggttaacgtcgacccgaacccggaaccgaacccccaaacccttcgtcta

SEQ ID NO: 556140 - DNA, 497 bp, Homo sapiens; identical to SEQ ID NO: 536371
  misc_feature: HIJSMM301D20A9.16.78.H01.1.454.light.4.raw

SEQ ID NO: 556141 - DNA, 511 bp, Homo sapiens
  misc_feature: HIJSMM301CDGQX.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctcgcccctcggtcactctcgtcccacctcct

SEQ ID NO: 556142 - DNA, 494 bp, Homo sapiens
  misc_feature: HIJSMM301EFNUR.16.73.G07.1.454.light.4.raw
tgtactactccacgaccggtgctcgatttagctctacgctcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcacggacagcctcctaagctgctcatttactgggcatctacccgggaatccggggtccctgaccgattcagtggcagcgggtctgggacagatttcactctcaccatcagcagcctgcaggctgaagatgtggcagtttattactgtcaacaatattataataatccatttaatttcggcggagggaccaaggtggagatcaaaacgaactgtggctgcaccatctgtcttcatcttcccgccta

SEQ ID NO: 556143 - DNA, 493 bp, Homo sapiens; identical to SEQ ID NO: 535657
  misc_feature: HIJSMM301BCPHP.27.78.H01.1.454.light.4.raw

SEQ ID NO: 556144 - DNA, 494 bp, Homo sapiens; identical to SEQ ID NO: 537153
  misc_feature: HIJSMM301C7RDX.11.59.F04.1.454.light.4.raw

SEQ ID NO: 556145 - DNA, 519 bp, Homo sapiens; identical to SEQ ID NO: 547713
  misc_feature: HIJSMM301C6U9L.5.27.C05.1.454.light.4.raw

SEQ ID NO: 556146 - DNA, 507 bp, Homo sapiens
  misc_feature: HIJSMM301EUOUI.15.66.F11.1.454.light.4.raw
tctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaagcccccaaaagtcatcatttatgagctcactaagcggccctcaggggtccctgatcgcttctctggctccaagtctggcgactcggcctccctgaccgtctctgggctccagcctgaagatgaggctgattattctgcggctcatatggagacaattacagctttgtcttcggaagtgggaccaaaggtcaccgtcctaagtcagcccaaggccaaccccaactgtcactctgttcccgccct

SEQ ID NO: 556147 - DNA, 495 bp, Homo sapiens
  misc_feature: HIJSMM301C44R4.49.20.B09.1.454.light.4.raw
agtcgagagacacgaccggtgctcgatttagtgtagtgtgaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaacaatatgcttactggtaccagcagaggccaggccaggccctcgtcttggtgatttataaagactttgtagaggccctcagggacccgtcgagcgattcttctggctccagctcagggacaacagtcaccttgaccatcagtggagtccggccagaggacgaggctgactattactgtcagtccgcagacagcagtggcagttatgtcgtattcggcggagggactacgctgaccgtcctaggtcagcccaaggctgccccctcggtcact

SEQ ID NO: 556148 - DNA, 490 bp, Homo sapiens
  misc_feature: HIJSMM301EELNQ.3.33.C11.1.454.light.4.raw
agacgcactccacgaccggtgctcgatttagagtgagctcgttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggaggaccaagctgaccgtcctaggtcagcccaaggctcg

SEQ ID NO: 556149 - DNA, 488 bp, Homo sapiens
  misc_feature: HIJSMM301CYDPV.17.36.D03.1.454.light.4.raw
cgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtctccgggggaaagagccaccctctcctgcagggccagtcagagtgttagcagctacttagcctggtaccaacagaaacctggccagtctcccaggctcctcatctatgatgcatccaacagggcccactggcatcccagccaggttcagtggcagtgggtctgggacagacttcattctcaccatcagcagcctagagcctgaagtattttgctagtttattactgtcagcagcgtagcaactggctcatcaccttcggccaagggacacgactggagatgaaacgaactgtggctgcacc

SEQ ID NO: 556150 - DNA, 514 bp, Homo sapiens
  misc_feature: HIJSMM301BX0PP.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtccactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccgccctcct

SEQ ID NO: 556151 - DNA, 486 bp, Homo sapiens; identical to SEQ ID NO: 535043
  misc_feature: HIJSMM301CEE6U.46.35.D02.1.454.light.4.raw

SEQ ID NO: 556152 - DNA, 488 bp, Homo sapiens; identical to SEQ ID NO: 535725
  misc_feature: HIJSMM301BC343.12.88.H11.1.454.light.4.raw

SEQ ID NO: 556153 - DNA, 502 bp, Homo sapiens
  misc_feature: HIJSMM301B4XTV.21.22.B11.1.454.light.4.raw
tcgtcgctcgcacgaccggtgctcgatttagacgacagctcaggggagcttcagctgtggtagagaagacaggactcaggacaatctcagcatggccggcttccctctcctcctcaccctcctcactcactgcgcagggtcctgggcccagtctgtgctgactcagccaccctcagcgtctgggacccccgggcagagggtcactatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactggaccgtcctaggtcagcccaa

SEQ ID NO: 556154 - DNA, 504 bp, Homo sapiens; identical to SEQ ID NO: 551974
  misc_feature: HIJSMM301CL1LU.19.78.H01.1.454.light.4.raw

SEQ ID NO: 556155 - DNA, 505 bp, Homo sapiens
  misc_feature: HIJSMM301BOFB1.19.78.H01.1.454.light.4.raw
tactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggcccaaccccactgtca

SEQ ID NO: 556156 - DNA, 516 bp, Homo sapiens; identical to SEQ ID NO: 551269
  misc_feature: HIJSMM301CSBOM.47.53.E09.1.454.light.4.raw

SEQ ID NO: 556157 - DNA, 480 bp, Homo sapiens
  misc_feature: HIJSMM301EC6HL.51.45.E01.1.454.light.4.raw
cgatcgtatacacgaccggtgctcgatttagtgagtcagtaagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaagcggccctcggggatacctgagcgattctctggctccacctctgggaacacagccactctgaccatcagcgggacgcaggctgtggatgaggctgacttttactgtcaggcgtgggacagcgacactgccgtgttcggcgagggaccaagctgaccgtcctcggtcagcccaaggctcg

SEQ ID NO: 556158 - DNA, 481 bp, Homo sapiens
  misc_feature: HIJSMM301A83AG.51.61.F06.1.454.light.4.raw
cgatcgtatacacgaccggtgctcgatttagctacgctctaagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaagcggccctcggggatacctgagcgattctctggctccacctctgggaacacagccactctgaccatcagcgggacgcaggctgtggatgaggctgacttttactgtcaggcgtgggacagcgacactgccgtgttcggcggagggaccaagctgaccgtctcggtcagcccaaggctccg

SEQ ID NO: 556159 - DNA, 508 bp, Homo sapiens
  misc_feature: HIJSMM301DUT77.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactatactgcctactctactttggtggtgctgtgctattcggcggagggaccaagctgaccgtcttaagtcagcccaaggctgccccctggtcactctgttccta

SEQ ID NO: 556160 - DNA, 489 bp, Homo sapiens; identical to SEQ ID NO: 535139
  misc_feature: HIJSMM301EM2I1.14.55.E11.1.454.light.4.raw

SEQ ID NO: 556161 - DNA, 490 bp, Homo sapiens
  misc_feature: HIJSMM301EFST6.52.71.G05.1.454.light.4.raw
cgcagtacgacacgaccggtgctcgatttagtgtcgtcgcaagagagaggggtgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtggcttgagctctggctcagtctctcctaatttctaccccagctggtaccagcagaccccaggccaggctccacgcacgctcatctacagcacaattactcgctcttctggggtccctgatcgcttctctggctccatccttgggaacaaagctgccctaaccatcacgggggcccaggcagatgatgaatctgattattactgtgtcctctatatgggtagtggcatttggatgttcggcggagggaccaagctgaccgtcctgggtcagccc

SEQ ID NO: 556162 - DNA, 500 bp, Homo sapiens; identical to SEQ ID NO: 546613
  misc_feature: HIJSMM301A3ZV2.11.21.B10.1.454.light.4.raw

SEQ ID NO: 556163 - DNA, 488 bp, Homo sapiens; identical to SEQ ID NO: 541295
  misc_feature: HIJSMM301DC95Q.9.59.F04.1.454.light.4.raw

SEQ ID NO: 556164 - DNA, 486 bp, Homo sapiens; identical to SEQ ID NO: 535043
  misc_feature: HIJSMM301DW76Y.46.35.D02.1.454.light.4.raw

SEQ ID NO: 556165 - DNA, 518 bp, Homo sapiens
  misc_feature: HIJSMM301C0SIY.5.27.C05.1.454.light.4.raw
atcagacacgcacgaccggtgctcgatttagacgcgatcgaagggtttgggggtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccgggatgaggccgactattactgtcaggtgtggaatggtgattatgattatgtcttcggaactggaccaaggtcaccgtcctaggtcagcccaaggccaacccactgtcactctgttcccgccctcctccgtgt

SEQ ID NO: 556166 - DNA, 453 bp, Homo sapiens; identical to SEQ ID NO: 535173
  misc_feature: HIJSMM301DGW10.19.86.H09.1.454.light.4.raw

SEQ ID NO: 556167 - DNA, 465 bp, Homo sapiens; identical to SEQ ID NO: 538589
  misc_feature: HIJSMM301DC0HJ.12.39.D06.1.454.light.4.raw

SEQ ID NO: 556168 - DNA, 486 bp, Homo sapiens; identical to SEQ ID NO: 536323
  misc_feature: HIJSMM301BT9XB.10.2.A02.1.454.light.4.raw

SEQ ID NO: 556169 - DNA, 459 bp, Homo sapiens; identical to SEQ ID NO: 548402
  misc_feature: HIJSMM301BI3DK.11.86.H09.1.454.light.4.raw

SEQ ID NO: 556170 - DNA, 506 bp, Homo sapiens
  misc_feature: HIJSMM301DFKMA.18.26.C04.1.454.light.4.raw
tacgagtatgcacgaccggtgctcgatttagtctagcgactttgggtttgggggggtcgagacccacgtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaaagcccctaacctcctgatcaagggtccgtccagtttccagagtggggcctcaacaaggttcagcggcagtggatctgggacagatttcactctcaccatcaaccagcctgcagcctgaagattttgcaacttactattgtcaacaggctgacaggttcccgctgactttcggcggagggaccaaggtagagatacaaaggaactgtggctgcaccatctgtcttcatcttcccgccta

SEQ ID NO: 556171 - DNA, 494 bp, Homo sapiens; identical to SEQ ID NO: 540110
  misc_feature: HIJSMM301C5J6G.51.71.G05.1.454.light.4.raw

SEQ ID NO: 556172 - DNA, 476 bp, Homo sapiens
  misc_feature: HIJSMM301C2YL7.26.72.G06.1.454.light.4.raw
agactatactcacgaccggtgctcgatttagctacgactgcaagggaaagggtgagatccctcactgtggctcactttcagcggagggaccacggtggagatcacacgtaagtgcactttcctaatgctttttcttataaggttttaagtttggagcgtttttgtgtttgagatgttagctcaggtcaattccaaagagtaccagattctttcaaaagtcagatgagtaagggatagaaaattagttcaccttaaggaacagccaagcgctagccagttaagtgaggcatctcaattgcaaggttttctctgcatcggtcaggttagtgatattaacagcgaaaagagaatttttgtaaggggaaagtaatgaagttaacactgtggatcaccttcggccaagggacacgactggagattaaacgaactgtggctgcaccatctgtcttcatcttcccgcatctgaagtatagtct

SEQ ID NO: 556173 - DNA, 499 bp, Homo sapiens
  misc_feature: HIJSMM301BAQ2T.10.65.F10.1.454.light.4.raw
catagtagtgcacgaccggtgctcgatttagctacgctctaagggggcaggagtcagtctcagtcaggacacagcatggacatgagggtccccgctcagctcctggggctcctgctactctggctccgaggtgccagatgtgacatccagatgacccagtctccaccgtccctgtctgcatttgttggagacagagtcaccatctcttgccggacaagtcagaacattgacacctatttgaattggtatcaacaaaaactggggaaagcccctacactcctgatcaatgcagcgtccagtttacagagtggggtccctcaaggttcagtggcagtggatctgggacagactttactctcaccatcagcgatctgcagcctgacgattttgcgacttactactgtcaacagagtttccggaaccccgttactttcggcggagggaccgaaggtggagatcaaacgaactgtggctgcaccatctgtcttcatcttccccg

SEQ ID NO: 556174 - DNA, 489 bp, Homo sapiens; identical to SEQ ID NO: 535139
  misc_feature: HIJSMM301C79II.14.55.E11.1.454.light.4.raw

SEQ ID NO: 556175 - DNA, 521 bp, Homo sapiens; identical to SEQ ID NO: 538715
  misc_feature: HIJSMM301CEGCU.27.23.C01.1.454.light.4.raw

SEQ ID NO: 556176 - DNA, 472 bp, Homo sapiens
  misc_feature: HIJSMM301DATHQ.49.62.F07.1.454.light.4.raw
agtcgagagacacgaccggtgctcgatttagtagtcgcataaagggaaagggggagtcagtcccaaccaggacacagcatggacatgagggtccctgctcagctcctggggctcctgctgctctggctctcaggtgccagatgtgtcatccagatgacccagtctccttcctccctgtctgcatctataggagacagaatcaccatcacttgccgggcgagtcgagacattagcatgtatctgaattggtatcagcaaaaaccagggacagcccctaaactcctgatcctcgatgcatccactttggagacaggggtcccatcaaggttcagtggaagtggctctgggacagattttacttcaccatcagcaggctgcagcctgaagatattgcaacatattactgtcaacagtatgatcgtctcccgctcacgttttcggcggggggacccaaggtggagatcaagcgaaa

SEQ ID NO: 556177 - DNA, 485 bp, Homo sapiens; identical to SEQ ID NO: 535688
  misc_feature: HIJSMM301BA9GR.19.5.A05.1.454.light.4.raw

SEQ ID NO: 556178 - DNA, 378 bp, Homo sapiens
  misc_feature: HIJSMM301D8L9A.49.29.C07.1.454.light.4.raw
agtcgagagacacgaccggtgctcgatttagagtgctacgaagggaaaggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtcgttataactttgtctcctggtaccagcaacacccaggcaacttcgcttttgtcttcggaactgggaccgaggtcaccgtcctgggtcagcccaaggccaaccccactgtcactctgttcccgccctcctctctctcgact

SEQ ID NO: 556179 - DNA, 491 bp, Homo sapiens
  misc_feature: HIJSMM301E1KTJ.48.22.B11.1.454.light.4.raw
agtatacatacacgaccggtgctcgatttagacgacagctcagggggcaggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaattttcgctgtctccagtttgcagagtggagtcccatctcggttcagcggcagtggatctggggcagagttcattctcaccatcaacagccttcagcctgaagattttgcaacttactattgtcagcagggtgacagtttccctcccactttcggcggagggaccagggtggacgtcaacgaactgtggctgcaccatctgtcttcatt

SEQ ID NO: 556180 - DNA, 497 bp, Homo sapiens; identical to SEQ ID NO: 535286
  misc_feature: HIJSMM301ANU74.18.59.F04.1.454.light.4.raw

SEQ ID NO: 556181 - DNA, 484 bp, Homo sapiens; identical to SEQ ID NO: 535240
  misc_feature: HIJSMM301A01O1.47.60.F05.1.454.light.4.raw

SEQ ID NO: 556182 - DNA, 464 bp, Homo sapiens
  misc_feature: HIJSMM301C1YBM.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactgacctctcactttcggcggagggaccagggtggagatcagacgaactgtggctgcaccatctgtcttcatcttcccgccatctgaagtatagtct

SEQ ID NO: 556183 - DNA, 491 bp, Homo sapiens
  misc_feature: HIJSMM301CXDWM.43.60.F05.1.454.light.4.raw
tgtgagtagtcacgaccggtgctcgatttagtacgtcatcagggaaagggggcaggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcggtccgacgggaccgaccggtggagtgtcaagcgaactcgtggctgcacca

SEQ ID NO: 556184 - DNA, 465 bp, Homo sapiens
  misc_feature: HIJSMM301BMVFP.17.28.C06.1.454.light.4.raw
cgtagactagcacgaccggtgctcgatttagagctcacgtattgggtttggagggtgtggtggtctccactcccgcccagtctgtgctgactcagccaccctcagtgtctgggacccccgggcagagggtcaccatatcttgttctggaaacagctccggcatctcaactaaacatttttgctggtaccagcaattcccaggatccggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggctgccccctcggtcactctgttcccgccctcctcctagtctacg

SEQ ID NO: 556185 - DNA, 501 bp, Homo sapiens
  misc_feature: HIJSMM301E0P46.10.68.G02.1.454.light.4.raw
catagtagtgcacgaccggtgctcgattagtcgatagtgaagggaaaggggggtgtgggctcaggaggcagagctctgggaatctcaccatggcctggacccctctcctgctccccctcctcactttctgcacagtctctgaggcctcgtatgaactgacacagccaccctcggtgtcagtgtccccaggacagactgccaggatcagctgctctggagatgcattgccaacaaaatatgcttattggtacgagcaaaagccaggccaggcccctgtcttgttgatatatgaggacaccaagcgaccctccggaatttctgagagattctccggctccagctcagggacagtggcctccttgactatcagtggggcccagggggtcgatgaggctgactactactgtttctcgactgacttcactggtaaacgttggctgttcggcggagggaccaagctgaccgtcctgcgtcagcccaaggctgccccctcggtccact

SEQ ID NO: 556186 - DNA, 486 bp, Homo sapiens; identical to SEQ ID NO: 535043
  misc_feature: HIJSMM301AYLXR.46.35.D02.1.454.light.4.raw

SEQ ID NO: 556187 - DNA, 494 bp, Homo sapiens; identical to SEQ ID NO: 534992
  misc_feature: HIJSMM301BWBKV.9.1.A01.1.454.light.4.raw

SEQ ID NO: 556188 - DNA, 486 bp, Homo sapiens; identical to SEQ ID NO: 537617
  misc_feature: HIJSMM301EJAI1.10.53.E09.1.454.light.4.raw

SEQ ID NO: 556189 - DNA, 444 bp, Homo sapiens; identical to SEQ ID NO: 535192
  misc_feature: HIJSMM301AE9OD.5.9.A09.1.454.light.4.raw

SEQ ID NO: 556190 - DNA, 492 bp, Homo sapiens
  misc_feature: HIJSMM301ES0R7.19.57.F02.1.454.light.4.raw
tactctcgtgcacgaccggtgctcgatttagctcgatatagttgggtttgggggcaggagtcaaacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgcaacttatttttgcaacaggctaacactttccccctcactttcggcggagggaccaaggtggagatcaagcgaactgtggctgcaccatctgtt

SEQ ID NO: 556191 - DNA, 498 bp, Homo sapiens; identical to SEQ ID NO: 535974
  misc_feature: HIJSMM301C7QP2.22.27.C05.1.454.light.4.raw

SEQ ID NO: 556192 - DNA, 490 bp, Homo sapiens; identical to SEQ ID NO: 537951
  misc_feature: HIJSMM301CSHZG.19.57.F02.1.454.light.4.raw

SEQ ID NO: 556193 - DNA, 511 bp, Homo sapiens
  misc_feature: HIJSMM301DCKI1.10.80.H03.1.454.light.4.raw
catagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctgtgggggagacagcattgaaagtgaagctgtccactggtaccagcagaggccaggccaggcccctgtactggtcctctatgatgatagtgaccggccctcagggatccctgagcgattctctggctccaactctgggaacacggccaccctgaccatcaccagggtcgaagccggggatgaggccgactattattgtcaggtgtggtatttcagtagtattcatccgggggttttcggcggagggaccaagctgaccgtctaggtcagcccaaggctgccccctggtcactctgttcccg

SEQ ID NO: 556194 - DNA, 303 bp, Homo sapiens
  misc_feature: HIJSMM301D2TPZ.13.11.A11.1.454.light.4.raw
tcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagacttttgcactttatttctgtcaccagtatggaactgtggctgcaccatctgtcttcatcttcccgccatctgatagtacgtga

SEQ ID NO: 556195 - DNA, 505 bp, Homo sapiens
  misc_feature: HIJSMM301AHAA6.48.68.G02.1.454.light.4.raw
agtatacatacacgaccggtgctcgatttagtcgatagtgaagggaaaggggggaggaactgctcagttaggacccagacggaaccatggaagccccagcgcagcttctcttcctcctgctactctggctcccagatgtcactggagaaaaataatgacgcagtctccagcccccctgcctgtgtctccaggggaaagagccaccctctcctgcagggccagtcagagtattagcagtgacttaaccttctacaaccagagacctggccaggctcccaggctcctggccaggtttccaggctcctcatccatggtgcatccaccagggccactggtatctcagccaggttcagtgccagtgggcctgggacagagttcactctcaccatcaccagcctgcagtctgaagattttgcattttattactgtcagcactataataactggccacgtggacgttcggccaagggaccaaggtggaaatcaaacgaactgtggctgcacc

SEQ ID NO: 556196 - DNA, 472 bp, Homo sapiens; identical to SEQ ID NO: 536302
  misc_feature: HIJSMM301AI6X5.18.76.G10.1.454.light.4.raw

SEQ ID NO: 556197 - DNA, 505 bp, Homo sapiens; identical to SEQ ID NO: 540309
  misc_feature: HIJSMM301CZCDK.5.68.G02.1.454.light.4.raw

SEQ ID NO: 556198 - DNA, 493 bp, Homo sapiens
  misc_feature: HIJSMM301A3BKQ.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgcccccccgatccaccttcggccaacgggacacgactggagattaaacgaactgtggctgcaccatctgtcttcatt

SEQ ID NO: 556199 - DNA, 486 bp, Homo sapiens
  misc_feature: HIJSMM301BL1RI.14.55.E11.1.454.light.4.raw
  modified_base (427)..(427): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctnactttcggcggagggaccaaggcggagatcagacgaactgtggctgcaccatctgtctt

SEQ ID NO: 556200 - DNA, 481 bp, Homo sapiens; identical to SEQ ID NO: 535993
  misc_feature: HIJSMM301DZS7W.21.25.C03.1.454.light.4.raw

SEQ ID NO: 556201 - DNA, 521 bp, Homo sapiens; identical to SEQ ID NO: 536990
  misc_feature: HIJSMM301B9H7G.27.23.C01.1.454.light.4.raw
  modified_base (517)..(517): a, c, t, g, unknown or other

SEQ ID NO: 556202 - DNA, 502 bp, Homo sapiens
  misc_feature: HIJSMM301CA1UX.41.18.B07.1.454.light.4.raw
tctatactatcacgaccggtgctcgatttagtcgctgcgtaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccgaagctgaccgtcctaggtcagcccaaggctgccccctcggtcactctgttccccg

SEQ ID NO: 556203 - DNA, 485 bp, Homo sapiens
  misc_feature: HIJSMM301APG5E.49.34.D01.1.454.light.4.raw
agtcgagagacacgaccggtgctcgatttagatcgtctgtgttgggtttgggggagctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgaagatgtggcagtgtattactgtcagcaatatcacactgctccgctcactttcggcggagggaccagggtggagatcaaaacg

SEQ ID NO: 556204 - DNA, 507 bp, Homo sapiens
  misc_feature: HIJSMM301B4ONF.49.31.C09.1.454.light.4.raw
agtcgagagacacgaccggtgctcgatttagacgtctcatcaaggaaggaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcactcaccatctcctgcactggtggttataactctgtctcctggtaccaacagcacccaggcaaagcccccaaactcatgatttatgaggtcaataggcggccctcaggggtccctgatcgcttctctggctccaagtctggcaccacggcctccctgaccgtctctgggctccaggcagaggatgaggctgattattactgcagctcatctgcaggcattaacaattttaatgtggtattcggcggagggaccaagctgaccgtcctaggtcagcccaaggctgccccctcggtcactctgttcccg

SEQ ID NO: 556205 - DNA, 503 bp, Homo sapiens; identical to SEQ ID NO: 535044
  misc_feature: HIJSMM301BWBB4.19.78.H01.1.454.light.4.raw

SEQ ID NO: 556206 - DNA, 514 bp, Homo sapiens
  misc_feature: HIJSMM301B79F0.7.87.H10.1.454.light.4.raw
  modified_base (493)..(493): a, c, t, g, unknown or other
cgtgtctctacacgaccggtgctcgatttagcagtactgcgttgggtttggggagctgctcagttaggacccagagggaaccatggaaacccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgtccgaaggaccgaaggtaggaaggtacaaacgaactagtggcgtgcaccactctcgtnttcctatcttcccgtcccact

SEQ ID NO: 556207 - DNA, 441 bp, Homo sapiens; identical to SEQ ID NO: 534971
  misc_feature: HIJSMM301EHDRX.11.3.A03.1.454.light.4.raw

SEQ ID NO: 556208 - DNA, 490 bp, Homo sapiens
  misc_feature: HIJSMM301CHRAW.16.72.G06.1.454.light.4.raw
tgtactactccacgaccggtgctcgatttagctacgactgcaagggaaagggggaggaactgctcagttaggacccagacggaaccatggaagccccagcgcagcttctcttcctcctgctactctggctcccagatacctctggagaaacagtgatgacgcagtctccagccaccctctctgtgtctccaggggaaagagtcaccctctcctgcagggccagtcagagtgttagcagcaacttagcctggtatcagcagaaacctggccaggctcccaggctcctcatctatgatgcatccaccagggccactggtatcccagccaggttcagtggcagtgggtttgggacagagttcactctcaccatcagcagcctgcagtctgaagattttgcagtttattactgtcagcagtataataactggcctccggtcactttcggcggagggaccaaggtggagatcaaacgaactgtggctgcacccat

SEQ ID NO: 556209 - DNA, 490 bp, Homo sapiens
  misc_feature: HIJSMM301DYQN6.4.24.C02.1.454.light.4.raw
agcactgtagcacgaccggtgctcgatttagtacagatcgttagggaaagggggagtcagactcagtcaggacacagcatggacatgagggtccccgctcagctcctggggctcctgctgctctggctcccaggtgccaaatgtgacgtccagatgacccagtctccttccaccctgtctgcatctataggagacagagtcaccatcacttgccgggccagtcagagtattagtaactggttggcctggtatcagcagaaaccaggcaaagccccaaaactccttatctctgatgcctccactttgcacggtggggtcccaccaacgttcagcggcagtgggtctgggacagaattcactctcaccatcagcagcctgcaacctgatgatgtgcaacttattactgtcaacaatataacagttattggacgttcggccaagggaccaaggtggaaatcagacgaactgtggctgcaccatctgtcttcta

SEQ ID NO: 556210 - DNA, 485 bp, Homo sapiens; identical to SEQ ID NO: 543222
  misc_feature: HIJSMM301BG0SL.52.22.B11.1.454.light.4.raw

SEQ ID NO: 556211 - DNA, 444 bp, Homo sapiens; identical to SEQ ID NO: 535192
  misc_feature: HIJSMM301A195K.5.9.A09.1.454.light.4.raw

SEQ ID NO: 556212 - DNA, 506 bp, Homo sapiens
  misc_feature: HIJSMM301AQ8CJ.5.86.H09.1.454.light.4.raw
atcagacacgcacgaccggtgctcgatttagtgctatagacttggggtttgggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcgggggtccctgatcgcttctctggctccaagtctggcaacacggcctccctgaccgtctctgggctccagactgaggatgaggctgactattactgcagctcatttgcaggcagccgtatactcttcggcggagggaccaagctgaccgtcctaggtcagcccaaggctgccccctcggtcact

SEQ ID NO: 556213 - DNA, 519 bp, Homo sapiens
  misc_feature: HIJSMM301E0132.48.57.F02.1.454.light.4.raw
agtatacatacacgaccggtgctcgatttagctcgatatagttgggtttggggagagaagacaggattcaggacaatctccagcatggccggcttccctctcctcctcaccctcctcactcactgtgcagggtcctgggcccagtctgtgttgactcagccaccctcaacgtctgggactcccgggcagaccgtcaccatctcttgttctggcagcagatggaacatcgggagcaattttgttcactggtaccagcaactgccaggagcggcccccaaactcctcatctacaggaatgataagcgaccctcaggggtccctgcccgattctctggctccaagtctggcaccacagcctccctggccatcagaggactccggtccgaggatgagggtgatttttattgtgctgtttgggatgacgacatgaatggttcgattttcggcggagggaccaaactgaccgtcctgggtcagcccaaggctgccccctcggtcactctgttcccgcctcctcta

SEQ ID NO: 556214 - DNA, 478 bp, Homo sapiens
  misc_feature: HIJSMM301A52CI.51.64.F09.1.454.light.4.raw
cgatcgtatacacgaccggtgctcgatttagcgcgtatacaagggggaggaactgctcagttaggacccagacggaaccatggaagccccagcgcagcttctcttcctcctgctactctggctcccagacaccactggacaaatagtgatgacgcagtctccaggcaccctgtctgtgtctccaggggaaagagccaccctctcctgcagggccagtcagagtgtttctaacaacctagcctggtatcagcagaagcctggccaggctcccaggctcctcatctatggttcatccaccagggccgctgatatcccagccaggttcagtggcagtgggtctgggacagaattcactctcaccatcagcagcctgcagtctgaagattttgcagtttattactgtcagcagtatgataagtggcctccgtacacttttggtccgacgggaccggagcgtggagatacaacgaaactgtgg

SEQ ID NO: 556215 - DNA, 383 bp, Homo sapiens; identical to SEQ ID NO: 447524
  misc_feature: HIJSMM301CRVDL.41.26.C04.1.454.light.4.raw

SEQ ID NO: 556216 - DNA, 488 bp, Homo sapiens
  misc_feature: HIJSMM301A6DY7.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaggcggagatcagacgaactgtgctgcaccatctgtcttcta

SEQ ID NO: 556217 - DNA, 477 bp, Homo sapiens
  misc_feature: HIJSMM301EGB2K.11.17.B06.1.454.light.4.raw
cgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccgggcaagtcagatcattagcagctatttaaattggtatcagcagaaaccagggaaagcccctgaggtcctgatctatgctgcatccagtttgcagagtggggtcccatcaaggttcagtggcagtggatctgcgacagatttcactctcaccatcagcagtctgcaacctgaagattttgcaacttactactgtcaacagagttacagtaccccgtggacgttcggccaaggaccaaggtaggaaatacaacgaactgtggctgca

SEQ ID NO: 556218 - DNA, 481 bp, Homo sapiens; identical to SEQ ID NO: 535993
  misc_feature: HIJSMM301A1274.21.25.C03.1.454.light.4.raw

SEQ ID NO: 556219 - DNA, 491 bp, Homo sapiens
  misc_feature: HIJSMM301ADHXI.12.57.F02.1.454.light.4.raw
atacgacgtacacgaccggtgctcgatttagctcgatatagttgggtttggggagagctctggggagtctgcaccatggcttggaccccactcctcttcctcaccctcctcctccactgcacagggtctctctcccaacttgtggtgactcaatcgccctctgcctctgcctctctgggagcctcggtcaagctcacctgcactctgagcagtgggcacactaccttcgccatcgcctggcatcaacaacagccagagaggggccctcgatacttgatgattgttaacagtgatggcagccacaacaagggggacgggatccctgatcgcttctcaggctccagttctggggctgagcgctacctcaccatctccagcctccagtctgaggatgaggctgactattactgtcagacctggggcactggcattgtggtattcggcggagggacgaagctgaccgtcctgggtcagcccaaggctgccccctc

SEQ ID NO: 556220 - DNA, 485 bp, Homo sapiens; identical to SEQ ID NO: 549401
  misc_feature: HIJSMM301C89KE.15.28.C06.1.454.light.4.raw

SEQ ID NO: 556221 - DNA, 485 bp, Homo sapiens; identical to SEQ ID NO: 536210
  misc_feature: HIJSMM301CTSQ9.43.54.E10.1.454.light.4.raw

SEQ ID NO: 556222 - DNA, 487 bp, Homo sapiens
  misc_feature: HIJSMM301C7XZK.52.58.F03.1.454.light.4.raw
cgcagtacgacacgaccggtgctcgatttagtctgatcgagaagggaaagggggaggtcagtctcagtcaggacacagcatggacatgagggtccccgctcagctcctggggctcctgctactctggctccgaggtgccagatgtgacacccagatgacccagtctccatcctccctgtctgcatctgtaggagacagagtcaccatcacttgccgggcaagtcagagcattggcaaatatttaaattggtatcagcagaaaccagggaaagcccctagactcctgatctatgctgcctccaatttgcaaagtggcgtcccatcgaggttcagtggccggggatctgggacaggacttcactctcaccatcagcggtcttcaaacctgaggactttggaacttactactgtcaggcagagtgataatacccctcagactttcggccctggactacagtggatgtcaaacgaactgtggctgcaccat

SEQ ID NO: 556223 - DNA, 488 bp, Homo sapiens; identical to SEQ ID NO: 535081
  misc_feature: HIJSMM301ATMY0.26.23.C01.1.454.light.4.raw

SEQ ID NO: 556224 - DNA, 492 bp, Homo sapiens
  misc_feature: HIJSMM301A0M6A.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcaatggatctggcacagctttcactctcaccgtcagcagcctgcagtctgaagattttgcaacttattactgtctacaagattcttcttaccctcggacgttcggtccacgggaccgacggtcggagtgtctaagacgaactacgtggcgtgcaccact

SEQ ID NO: 556225 - DNA, 487 bp, Homo sapiens
  misc_feature: HIJSMM301C3HHZ.46.26.C04.1.454.light.4.raw
actagcagtacacgaccggtgctcgatttagtctagcgactttgggtttggggtggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcgggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaaggtggagatcaaacgaact

SEQ ID NO: 556226 - DNA, 495 bp, Homo sapiens; identical to SEQ ID NO: 554198
  misc_feature: HIJSMM301EYLE2.41.53.E09.1.454.light.4.raw

SEQ ID NO: 556227 - DNA, 493 bp, Homo sapiens; identical to SEQ ID NO: 541489
  misc_feature: HIJSMM301D7DTU.12.23.C01.1.454.light.4.raw

SEQ ID NO: 556228 - DNA, 455 bp, Homo sapiens; identical to SEQ ID NO: 535447
  misc_feature: HIJSMM301EEMBE.19.71.G05.1.454.light.4.raw

SEQ ID NO: 556229 - DNA, 500 bp, Homo sapiens; identical to SEQ ID NO: 551915
  misc_feature: HIJSMM301BWB4L.18.11.A11.1.454.light.4.raw

SEQ ID NO: 556230 - DNA, 444 bp, Homo sapiens; identical to SEQ ID NO: 535192
  misc_feature: HIJSMM301EIPMT.5.9.A09.1.454.light.4.raw

SEQ ID NO: 556231 - DNA, 520 bp, Homo sapiens
  misc_feature: HIJSMM301B4PT9.41.19.B08.1.454.light.4.raw
tctatactatcacgaccggtgctcgatttagtgagtcagtaaggggggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaaccccactgtcactctgttcccaccctcctcat

SEQ ID NO: 556232 - DNA, 510 bp, Homo sapiens
  misc_feature: HIJSMM301AMBE6.21.87.H10.1.454.light.4.raw
tcgtcgctcgcacgaccggtgctcgatttagcagtactgcgttgggtttggggggggtcacaagaggcagcgctctcgggacgtctccaccatggcctgggctctactgctcctcactctcctcactcagggcacagggtcctgggcccagtctgccctgactcagcctgcctccgtgtctgggtctcccgggcagtcggtcaccatctcttgcgctggatccagcgatgatattggacgttttaaccttgtctcctggtatcaacaacaccaggacaaagccccaaaactcttaatttctggcgtcaatcagcgaccctcacatgtttccagtcgattctctgcatccaagtctggcaacacggcctttctgacaatctctcaactccaggctgaagacgaggctatttattactgctcctcatacgcaggtggcactatttttcttggtttttggcggcgggacccagatgactgtcctcagtcagcccaaggctgccccctggtcta

SEQ ID NO: 556233 - DNA, 493 bp, Homo sapiens
  misc_feature: HIJSMM301AFEYY.10.59.F04.1.454.light.4.raw
catagtagtgcacgaccggtgctcgatttagtacacacacttagggattggggggggtcgtcaggaggcagcactctcgggacggtctccaccatggcctgggctctgctcctcctcagcctcctcactcagggcacaggatcctgggctcagtctgccctgactcagcctcgctcagtgtccgggtctcctgggcagtcagtcaccatctcctgcactggaaccagcagtgatgttggtggttatgactttgtctcctggtaccaacagcagccaggcgaagcccccaaattcatgatttatgatgtcagtgcgcggccctcgggggtccctgatcgcttctctggctccaagtctggcaacacggcctccctgaccatctctggcctccagcctgaggatgaggctgattattactgttgctcatatgcaggcggtaccgcttgggtgttcggcggagggaccaagctgaccgtcctaggtcgagaccccg

SEQ ID NO: 556234 - DNA, 378 bp, Homo sapiens; identical to SEQ ID NO: 547290
  misc_feature: HIJSMM301D5MR4.40.9.A09.1.454.light.4.raw

SEQ ID NO: 556235 - DNA, 521 bp, Homo sapiens; identical to SEQ ID NO: 538715
  misc_feature: HIJSMM301BA6DJ.27.23.C01.1.454.light.4.raw

SEQ ID NO: 556236 - DNA, 497 bp, Homo sapiens
  misc_feature: HIJSMM301ARNJE.13.6.A06.1.454.light.4.raw
tcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcgggcctccggggtccctaacaggttcagtggcagtggatcaggcacagattttacactgaaaatcagcagagtggaggctgaggatgttggggtttattactgcatgcaagctctacaacctctgcggactttcggccctgggaccaaagtggagatcaaacgaactagttggctgcaccatctgtctta

SEQ ID NO: 556237 - DNA, 460 bp, Homo sapiens; identical to SEQ ID NO: 536053
  misc_feature: HIJSMM301B2ITG.22.28.C06.1.454.light.4.raw

SEQ ID NO: 556238 - DNA, 349 bp, Homo sapiens; identical to SEQ ID NO: 537129
  misc_feature: HIJSMM301BG3ZY.13.11.A11.1.454.light.4.raw

SEQ ID NO: 556239 - DNA, 501 bp, Homo sapiens
  misc_feature: HIJSMM301ANIM1.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttgggtttatactgcatgcaactacacacggccgctcactttcggcggagggaccaaggtggagatcaaacgaactgtggctgcacatctgt

SEQ ID NO: 556240 - DNA, 486 bp, Homo sapiens
  misc_feature: HIJSMM301A608L.14.53.E09.1.454.light.4.raw
cgtctagtaccacgaccggtgctcgatttagagagagtgtgttgggtttgggggggagcctagctgtgctgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgtgacaaagcagtatgtctttttggtaccagcagaagccaggccaggcccctctcttgattatatataaggacactgagaggccctcgagggatccctgagcgattctctggctccagctcagggacaacactcaccttgaccatcagtgcagtccaggcagaagacgaggctgactattattgtcaatcagcagtcagcactaattcttatcggtgttcggcggagggaccaagctgaccgtccta

SEQ ID NO: 556241 - DNA, 463 bp, Homo sapiens; identical to SEQ ID NO: 535062
  misc_feature: HIJSMM301CHGCV.11.73.G07.1.454.light.4.raw

SEQ ID NO: 556242 - DNA, 496 bp, Homo sapiens; identical to SEQ ID NO: 538149
  misc_feature: HIJSMM301D80QY.13.67.G01.1.454.light.4.raw

SEQ ID NO: 556243 - DNA, 485 bp, Homo sapiens; identical to SEQ ID NO: 538533
  misc_feature: HIJSMM301CKQN9.47.78.H01.1.454.light.4.raw

SEQ ID NO: 556244 - DNA, 523 bp, Homo sapiens
  misc_feature: HIJSMM301DQLHM.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcgggagggaccgaaggtaggaggatcaaacgaaaccgtggtcggtgtcgaccactactcgttcgtt

SEQ ID NO: 556245 - DNA, 501 bp, Homo sapiens
  misc_feature: HIJSMM301CDC7C.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgcccccaaactcactgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtctaggtcagccaaggccaaccc

SEQ ID NO: 556246 - DNA, 484 bp, Homo sapiens; identical to SEQ ID NO: 537878
  misc_feature: HIJSMM301A3LF6.17.34.D01.1.454.light.4.raw

SEQ ID NO: 556247 - DNA, 494 bp, Homo sapiens; identical to SEQ ID NO: 541035
  misc_feature: HIJSMM301BV8HA.26.12.B01.1.454.light.4.raw

SEQ ID NO: 556248 - DNA, 503 bp, Homo sapiens
  misc_feature: HIJSMM301ETDJZ.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactacttacctcaagtgatcaccttcggccaagggacacgactggagattaaaacg

SEQ ID NO: 556249 - DNA, 497 bp, Homo sapiens
  misc_feature: HIJSMM301B7C3L.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccaaaataagaggtcaaacgaactgtggctgcaccatctgt

SEQ ID NO: 556250 - DNA, 506 bp, Homo sapiens
  misc_feature: HIJSMM301CJ6X5.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccgaaataagaggtacaacgaactagtggcgtgcaccatctgtcttctat

SEQ ID NO: 556251 - DNA, 504 bp, Homo sapiens
  misc_feature: HIJSMM301DJ000.48.36.D03.1.454.light.4.raw
agtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcggggtccctgatcgcttctctggctccaagtctggcaacacggcctccctgaccatctctgggctccaggctgaagatcaggctgattattactgctgttcattttctaagttcctttttgtctttcggaactgggaccgaggtcaccgtcctaggtcagcccaaggccaacccactgtcta

SEQ ID NO: 556252 - DNA, 485 bp, Homo sapiens; identical to SEQ ID NO: 536307
  misc_feature: HIJSMM301BZWI0.46.35.D02.1.454.light.4.raw

SEQ ID NO: 556253 - DNA, 500 bp, Homo sapiens
  misc_feature: HIJSMM301BBW0K.12.86.H09.1.454.light.4.raw
atacgacgtacacgaccggtgctcgatttagtgctatagacttgggtttgggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaaagggccactggcatcccagccaggttcagtggcagtgggtctggggcagacttcactctcaccatcagcagcctagagcctgaagattttgcagtttattactgtcagcagcgtagcaactggcctcggttcacttttggccaggggaccaagctggagatcaacgaactgtggctgcaccatctgtcttcatt

SEQ ID NO: 556254 - DNA, 494 bp, Homo sapiens; identical to SEQ ID NO: 535276
  misc_feature: HIJSMM301A5ZH9.16.6.A06.1.454.light.4.raw

SEQ ID NO: 556255 - DNA, 504 bp, Homo sapiens
  misc_feature: HIJSMM301BL56O.48.26.C04.1.454.light.4.raw
agtatacatacacgaccggtgctcgatttagtctagcgactttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaagctgaccgtcctaggtcagcccaaggctgccccctcggt

SEQ ID NO: 556256 - DNA, 503 bp, Homo sapiens
  misc_feature: HIJSMM301EEQ3O.40.41.D08.1.454.light.4.raw
tctagcgactcacgaccggtgctcgatttagtcacgcgagaaagggaaagggggagagactgaagaacccagcattgcagcagctccaccatggcctgggctcctctgctcctcaccctcctcagtctcctcacagggtccctctcccagcctgtgctgactcagccaccttctgcatcagcctccctgggagcctcggtcacactcacctgcaccctgagcagcggctacagtaattataaagtggactggtaccagcagagaccagggaagggcccccggtttgtgatgcgagtgggcactggtgggattgtgggatccaagggggatggcatccctgatcgcttctcagtcttgggctcaggcctgaatcggtacctgaccatcaagaacatccaggaagaggatgagagtgactaccactgtggggcagaccatggcagtgggagcaacttcggggtgttcggcggagggaccaagctgaccgtcctaggtcagacccg

SEQ ID NO: 556257 - DNA, 488 bp, Homo sapiens
  misc_feature: HIJSMM301AFX1U.52.3.A03.1.454.light.4.raw
cgcagtacgacacgaccggtgctcgatttagagagcgtcacaggggggagtcagacccagtcaggacacagcatggacatgagggtccccgctcagctcctggggctcctgctgctctggctcccaggtgccaaatgtgacatccagatgacccagtctccttccaccctgtctgcatctgttggagacagagtcaccatctcttgccgggccagtcagagtattagtacctcgttggcctggtatcagaagaaaccagggaaagcccctaaactcctgatctctaaggcatctgatttacaaactggggtcccgtcaaggttcagcggcagtggatctgggacagacttcactctcaccatcagcagcctgcagcctgatgactttgcaagttattattgccaacagtataacagtttttcattcacttttggccctgggacgacagtggatatcaaacgaactgtggctgcaccatctgtcttcta

SEQ ID NO: 556258 - DNA, 500 bp, Homo sapiens
  misc_feature: HIJSMM301CHBQ1.40.42.D09.1.454.light.4.raw
tctagcgactcacgaccggtgctcgatttagacacatacgcagggaaagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagaagcattgccaaaaaaatatgcttattggtaccaacagaagtcaggccaggcccctgtgctggtcatctatgaggacaacaaacgaccctccgagatccctgagagattctctggctccagctcagggacaatggccaccttggctctcagtggggcccaggtggaggatgaagctgactactactgttactcagtggacagcagtggaaatcatggggtattcggcggagggaccaagctgaccgtcctaggtcagcccaaggctgccccctcggtcta

SEQ ID NO: 556259 - DNA, 497 bp, Homo sapiens; identical to SEQ ID NO: 536371
  misc_feature: HIJSMM301EGQ5P.16.78.H01.1.454.light.4.raw

SEQ ID NO: 556260 - DNA, 484 bp, Homo sapiens
  misc_feature: HIJSMM301A6800.3.55.E11.1.454.light.4.raw
agacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtatcccagccaggttcagtggcagtgggtctgggacagagttcattctcaccatcagcagcctgcagtctgaagattttgcaatttatactgtcagcagtataataactggtggacgttcggccaagggaccaaggtagaaatcaaacgaactgtggctgcaccatct

SEQ ID NO: 556261 - DNA, 506 bp, Homo sapiens; identical to SEQ ID NO: 539434
  misc_feature: HIJSMM301BRMI4.48.71.G05.1.454.light.4.raw

SEQ ID NO: 556262 - DNA, 515 bp, Homo sapiens
  misc_feature: HIJSMM301AYYPU.40.27.C05.1.454.light.4.raw
tctagcgactcacgaccggtgctcgatttagacgcgatcgaagggtttggggagcttcagctgtggtggagaagacaggattcaggccaatctccagcatggccggcttccctctcctcctcaccctcctcactcactgtgcagggtcctgggcccagtctgtgctgactcagccaccctcagcgtctgagacccccgggcagcaggttaccgtctcttgttctggaagcagctccaacatcggaagtaattctgtatactggtaccagtgcctcccaggaacggcccccaaacttctcgtctatagggattatcagcggcccttaggggtccctgaccgattctctggctccaggtctggcacctcagcctccctggccatcagtgggctccggcccgaggatgaggcggattattattgtgtgtcatgggatgacagaatgaatggtccggtgttcggcggagggaccaggctgaccgtcctaggtcagcccaaggctgccccctcggtcact

SEQ ID NO: 556263 - DNA, 504 bp, Homo sapiens; identical to SEQ ID NO: 535077
  misc_feature: HIJSMM301AT9UL.8.28.C06.1.454.light.4.raw

SEQ ID NO: 556264 - DNA, 511 bp, Homo sapiens
  misc_feature: HIJSMM301ANQPK.43.23.C01.1.454.light.4.raw
tgtgagtagtcacgaccggtgctcgatttagtacacgtgattagggattggggtctggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcgggggcaaagctgccctgacactgtcaggtgtgcagcctgaggacgaggctgactattactgcctgctcatatatggtggcgcgtgggtgttcggcgagggaccaagctgaccgtctgggtcagcccaaggctgccccctggtcactctgttcccgccct

SEQ ID NO: 556265 - DNA, 488 bp, Homo sapiens
  misc_feature: HIJSMM301A4DKP.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatcgaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaaacaatattattatacttctggacgttcggccaagggaccaaggtggatatcagacgaa

SEQ ID NO: 556266 - DNA, 403 bp, Homo sapiens
  misc_feature: HIJSMM301BSN5I.4.35.D02.1.454.light.4.raw
agcactgtagcacgaccggtgctcgatttagcacacgatagttgggtttgggtttcatgagtgcagggagacggccaggattacttgtgggggagacaacattggagataaaagtgtgcactggtaccagcagaagccaggccaggcccctctgatggtcatctatttcgatagcgaccggccctcaggaatccctgcgcgattctcggggtccaactctgggagcacggccaccctgaccatcagtagtgtcgaagccggtgatgaggccgactatttctgtcaggtgtgggctactcgcagtgacctctgcgtcttcggaagtgggaccaaggtcaccgtcttaggtcagcccaaggccaaccccactgtcactctgttcccaccctcctcctacagtgct

SEQ ID NO: 556267 - DNA, 473 bp, Homo sapiens; identical to SEQ ID NO: 546716
  misc_feature: HIJSMM301DKQ1O.52.49.E05.1.454.light.4.raw

SEQ ID NO: 556268 - DNA, 486 bp, Homo sapiens
  misc_feature: HIJSMM301B02J1.41.2.A02.1.454.light.4.raw
tctatactatcacgaccggtgctcgatttagactcatctacagggggcaggagtcagtcccaaccaggacacagcatggacatgagggtccctgctcagctcctggggctcctgctgctctggctctcaggcgccagatgtgacatccagatgacccagtctccatcctccctgtctgcatctttaggagacagagtcaccatctcttgtcaggcgaatgaggacattaacgtttatttaaattggtatcggcagagaccagggaaagcccctgagctcctgatttatgataaatcgaatttgaatccagggtcccatctaggttccgtggaagtggatctgggacagactttactctcaccattagcagcctggagcctgaagatattgcaacatattactgtcaacagtctcatggtctcccccttagtttcggcggagggaccaaggtgagatcaaacgaactgtggctgcaccatctgtctt

SEQ ID NO: 556269 - DNA, 488 bp, Homo sapiens; identical to SEQ ID NO: 535725
  misc_feature: HIJSMM301BPMNQ.12.88.H11.1.454.light.4.raw

SEQ ID NO: 556270 - DNA, 509 bp, Homo sapiens; identical to SEQ ID NO: 543772
  misc_feature: HIJSMM301ECF7W.2.21.B10.1.454.light.4.raw

SEQ ID NO: 556271 - DNA, 489 bp, Homo sapiens; identical to SEQ ID NO: 546315
  misc_feature: HIJSMM301ECRC1.43.33.C11.1.454.light.4.raw

SEQ ID NO: 556272 - DNA, 485 bp, Homo sapiens
  misc_feature: HIJSMM301AI35D.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgataactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccagggaccaagctggagatcaaacgaactgtggctgcaccat

SEQ ID NO: 556273 - DNA, 485 bp, Homo sapiens
  misc_feature: HIJSMM301BU9WO.49.81.H04.1.454.light.4.raw
  modified_base (469)..(469): a, c, t, g, unknown or other
agtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaatagggtcccatcaaggttcagtggaagtggatctgggacgtattttactttcaccatcatcaacctgcagcctgaggatattgcaacatattactgtcaacaataatgataatctaccactcactttcgcggaggacgacgtggagatcaaacgaactagtggctcgnaccaatctgtcttcta

SEQ ID NO: 556274 - DNA, 480 bp, Homo sapiens
  misc_feature: HIJSMM301BX1WF.48.70.G04.1.454.light.4.raw
agtatacatacacgaccggtgctcgatttagtgtagtgtgaagggaaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttatcactatgtctcctggtaccaacagcaccctggcaaagcccccaaactcatgatttatgatatcactaagcggccctcaggggtccctgatcgcttctctggctcccagtctggcaacacggcctccctgaccatctctgggctccaggctgaggatgaggctgattattactgctgctcatatgcaggcagctacacttttggtgttcggcggagggaccaagctgactgtccg

SEQ ID NO: 556275 - DNA, 499 bp, Homo sapiens
  misc_feature: HIJSMM301DYXT0.43.53.E09.1.454.light.4.raw
tgtgagtagtcacgaccggtgctcgatttagagagagtgtgttgggtttgggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacacggtcaccgtcctaggtcagcccaaggtcaaccccta

SEQ ID NO: 556276 - DNA, 484 bp, Homo sapiens
  misc_feature: HIJSMM301C84TP.26.70.G04.1.454.light.4.raw
agactatactcacgaccggtgctcgatttagtgtagtgtgaagggaaagggggcaggaatcagacccagtcaggacacagcatggacatgagagtcctcgctcagctcctggggctcctgctgctctgtttcccaggtgccagatgtgacatccagatgacccagtcgccatcctcactgtctgcctctgtaggagacagagtcaccatcacttgtcgggcgagtcagggcattagcgattttttagcctggtttcagcagaaaccagggaaagcccccaagtccctgatctatgctgcgtccactttagaaggtggagtcccatcaaggttcagcggcagtggatctgggacagagttcactctcaacatcagcagcctgcagcctgaggattttgcaacttattactgccagcagtataatgattaccctatcaccttcggccggggacacggctggaaactaacgaactgtggctgcacca

SEQ ID NO: 556277 - DNA, 447 bp, Homo sapiens; identical to SEQ ID NO: 535201
  misc_feature: HIJSMM301B0LDE.18.9.A09.1.454.light.4.raw

SEQ ID NO: 556278 - DNA, 445 bp, Homo sapiens
  misc_feature: HIJSMM301DWF5K.5.9.A09.1.454.light.4.raw
atcagacacgcacgaccggtgctcgatttagcgagacgcgcagggtcctgggcccagtctgtgatgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctgccccctcggtcactctgttccccgccctcctccgtgtctgat

SEQ ID NO: 556279 - DNA, 496 bp, Homo sapiens
  misc_feature: HIJSMM301DY8N2.41.45.E01.1.454.light.4.raw
tctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccaagctgaccgtcctgggtcagcccaaggctgcccctcggtcact

SEQ ID NO: 556280 - DNA, 494 bp, Homo sapiens
  misc_feature: HIJSMM301DSKQU.12.87.H10.1.454.light.4.raw
atacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcattgggggaaaagtttgctttctggtatcagcagaagccaggccagtcccctgtcttggtcatctataaggatagcaggcggccctcagggattcctgagcgattctccggctccaactccggcaacacagccactctgaccatcagcgggacccaggctctcgatgaggctgactattactgccaggcgtgggacagctccacttcccgttatgtcttcggaggtgggaccatggtcaccgtcctaggtcagcccaagaccaacccact

SEQ ID NO: 556281 - DNA, 508 bp, Homo sapiens
  misc_feature: HIJSMM301AOB0W.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcgccaagggaccgaaggtaggaatacaaacgaactagtggcgtgcaccactctgtcttctactcttccccg

SEQ ID NO: 556282 - DNA, 478 bp, Homo sapiens; identical to SEQ ID NO: 535129
  misc_feature: HIJSMM301A61TZ.11.11.A11.1.454.light.4.raw

SEQ ID NO: 556283 - DNA, 506 bp, Homo sapiens
  misc_feature: HIJSMM301BJRU8.48.20.B09.1.454.light.4.raw
agtatacatacacgaccggtgctcgatttagtgtagtgtgaagggtgaggaggagaggggagcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggagtaattatgtatcctggttccagcagttcccaggaacagcccccaaactcctcattcatgacactaataagcgaccctcaggcattcctgaccgattctctggctccaagtctggcacgtcagccaccctgggcatcaccggactccagactggggacgaggccgattattactgcggaacatgggaaggcagcctgagtgctacccagtgggtgttcggcggagggaccaagctgaccgtcctaggtcagcccaaggctgccccctcggtca

SEQ ID NO: 556284 - DNA, 521 bp, Homo sapiens; identical to SEQ ID NO: 539470
  misc_feature: HIJSMM301CZLQ3.27.23.C01.1.454.light.4.raw

SEQ ID NO: 556285 - DNA, 492 bp, Homo sapiens
  misc_feature: HIJSMM301EA3CE.53.4.A04.1.454.light.4.raw
cgcgtatacacacgaccggtgctcgatttagagtagtgatcagggggcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggttatcatctcctgcactgggaccagctccaacatcgggtcaggttatgatgtacactggtaccagcagcttccaggaacagcccccaaactcctcgtctatggtgacggcagtcggccctcaggggtccctggccgattctctggctccaagtctggcacctcagcctccctggccatcactgggctccaggctgaggatgagggtcattattactgccagtcctatgacaacagaatggatccttcttgggtgttcggcggagggaccaagctgaccgtcctacgtcacg

SEQ ID NO: 556286 - DNA, 503 bp, Homo sapiens; identical to SEQ ID NO: 545379
  misc_feature: HIJSMM301DOBF9.9.53.E09.1.454.light.4.raw

SEQ ID NO: 556287 - DNA, 487 bp, Homo sapiens
  misc_feature: HIJSMM301DUE6P.10.2.A02.1.454.light.4.raw
catagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccaccctctcctgcagggccagtcagagtgttggcagcaggttagcctggtaccagcagaaacgtggccaggctcccaggctcctcgtatatggtgcatccaccagggccactggtatctcaggcaggttccgtggcagtgggtctgggacagagttcactgtcaccatcagcagcctgcagtctgaagattttgcagtttattactgtcagcagtataatagctggcccgcgacgttcggccaagggaccgaggtggaattcaaacgaactagtggctgcaccatctgtctt

SEQ ID NO: 556288 - DNA, 488 bp, Homo sapiens
  misc_feature: HIJSMM301B03ET.40.83.H06.1.454.light.4.raw
tctagcgactcacgaccggtgctcgatttagatcacgtgcgtcgcggggtccaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttcagcatgggacggcagcctcagtgaatgggtgttcgggcggagggaccaaactgtccgtcctaggtcagccccg

SEQ ID NO: 556289 - DNA, 499 bp, Homo sapiens; identical to SEQ ID NO: 536875
  misc_feature: HIJSMM301DCUMU.51.26.C04.1.454.light.4.raw

SEQ ID NO: 556290 - DNA, 484 bp, Homo sapiens; identical to SEQ ID NO: 535400
  misc_feature: HIJSMM301DAQ0B.46.26.C04.1.454.light.4.raw

SEQ ID NO: 556291 - DNA, 513 bp, Homo sapiens; identical to SEQ ID NO: 535719
  misc_feature: HIJSMM301D4O9Z.17.33.C11.1.454.light.4.raw

SEQ ID NO: 556292 - DNA, 501 bp, Homo sapiens; identical to SEQ ID NO: 536867
  misc_feature: HIJSMM301ENB1N.5.86.H09.1.454.light.4.raw

SEQ ID NO: 556293 - DNA, 444 bp, Homo sapiens; identical to SEQ ID NO: 535027
  misc_feature: HIJSMM301AGA37.8.73.G07.1.454.light.4.raw

SEQ ID NO: 556294 - DNA, 496 bp, Homo sapiens; identical to SEQ ID NO: 538149
  misc_feature: HIJSMM301D6FMO.13.67.G01.1.454.light.4.raw

SEQ ID NO: 556295 - DNA, 486 bp, Homo sapiens; identical to SEQ ID NO: 535043
  misc_feature: HIJSMM301ADNH2.46.35.D02.1.454.light.4.raw

SEQ ID NO: 556296 - DNA, 488 bp, Homo sapiens; identical to SEQ ID NO: 542699
  misc_feature: HIJSMM301AK5J8.12.51.E07.1.454.light.4.raw

SEQ ID NO: 556297 - DNA, 504 bp, Homo sapiens; identical to SEQ ID NO: 538940
  misc_feature: HIJSMM301A20Y6.2.35.D02.1.454.light.4.raw

SEQ ID NO: 556298 - DNA, 487 bp, Homo sapiens
  misc_feature: HIJSMM301ADXK8.47.78.H01.1.454.light.4.raw
agctcacgtacacgaccggtgctcgatttagtgtgagtagtttgggtttgggaacctatgaacattctgtaggggccactgtcttctccacggtgctcccttcatgcgtgactcagccaccctcagcgtctgggacccccgggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcagcctccctggccatcagtgggctccggtccgaggatgaggctgattattattgtgcaacatgggatagtagcctgagtagtgtggttttcggcggagggaccaaactgaccgtcctaggtcagcccaaggctcgccccctcggtcactctcgttcccaccctcctctacgtgagct

SEQ ID NO: 556299 - DNA, 486 bp, Homo sapiens; identical to SEQ ID NO: 535043
  misc_feature: HIJSMM301CIK7N.46.35.D02.1.454.light.4.raw

SEQ ID NO: 556300 - DNA, 524 bp, Homo sapiens
  misc_feature: HIJSMM301AW109.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacgttgggtgttcggcggagggaccaggctgaccgtcctaggtcagcccaaggctcgccccctcggtcactctcgttcccaccct

SEQ ID NO: 556301 - DNA, 503 bp, Homo sapiens
  misc_feature: HIJSMM301A860P.48.25.C03.1.454.light.4.raw
agtatacatacacgaccggtgctcgatttagtagtgtagatttgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctttgaggacaacaaacgaccctccgggatccctgagagattctctggctccagctcagggacaatggccaccttgactatcaatggggcccaggtggacgatgaggctgactactactgttcctcaacagacagtagtggtgatcgagggctgttcggcggagggaccaagctgaccgtcctaagtcagcccaaggctgccccctcggtcactctgt

SEQ ID NO: 556302 - DNA, 472 bp, Homo sapiens; identical to SEQ ID NO: 536302
  misc_feature: HIJSMM301EHVZ2.18.76.G10.1.454.light.4.raw

SEQ ID NO: 556303 - DNA, 490 bp, Homo sapiens; identical to SEQ ID NO: 535234
  misc_feature: HIJSMM301CBB7H.17.21.B10.1.454.light.4.raw

SEQ ID NO: 556304 - DNA, 462 bp, Homo sapiens; identical to SEQ ID NO: 546233
  misc_feature: HIJSMM301A203L.52.8.A08.1.454.light.4.raw

SEQ ID NO: 556305 - DNA, 487 bp, Homo sapiens
  misc_feature: HIJSMM301EFNFA.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagttttatattgtcaaacaatattattatacttcgtggacgttcggccaagggaccaaggtggatatcagacgaa

SEQ ID NO: 556306 - DNA, 444 bp, Homo sapiens; identical to SEQ ID NO: 538511
  misc_feature: HIJSMM301CD59D.5.9.A09.1.454.light.4.raw
  modified_base (426)..(426): a, c, t, g, unknown or other

SEQ ID NO: 556307 - DNA, 485 bp, Homo sapiens
  misc_feature: HIJSMM301AT67S.49.64.F09.1.454.light.4.raw
agtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccggggaaggcccctaagttactgatctatgctgcagccaatttgcaaagtggggtcccatcaaggttcagtggcagtggatctgggacagaattcactctcaccatcagcagtctgcaacctgaagattttggaaagtactattgtcaacagagttacggaaacttgctcattttcggcggagggaccaaggtggagatcaaaagaactgtggctgcaccatctgtcttc

SEQ ID NO: 556308 - DNA, 494 bp, Homo sapiens; identical to SEQ ID NO: 535629
  misc_feature: HIJSMM301CA13K.4.27.C05.1.454.light.4.raw

SEQ ID NO: 556309 - DNA, 504 bp, Homo sapiens
  misc_feature: HIJSMM301BUVBQ.48.53.E09.1.454.light.4.raw
agtatacatacacgaccggtgctcgatttagagagagtgtgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcaaaaacctggccaaactcccaggctcctcatctatggtgcatccaccagggccactggaatcccaaccaggttcagtggcagagggtctgggacggaattcactctcaccatcagcagtctgcagtctgaagattttgcagtttattattgtcagcagtataataattggcctccgggggtcactttcggccctgggaccaaaataaatagtcaatcgaactgtggctgcaccatctgtcttcatt

SEQ ID NO: 556310 - DNA, 523 bp, Homo sapiens
  misc_feature: HIJSMM301AE8W8.5.27.C05.1.454.light.4.raw
atcagacacgcacgaccggtgctcgatttagacgcgatcgaagggtttggggagtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctcgttcccgccctcctccgtcg

SEQ ID NO: 556311 - DNA, 484 bp, Homo sapiens; identical to SEQ ID NO: 535211
  misc_feature: HIJSMM301AOP9K.47.46.E02.1.454.light.4.raw

SEQ ID NO: 556312 - DNA, 506 bp, Homo sapiens
  misc_feature: HIJSMM301CU5LS.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataatttctgggtgttcggcggagggaccaaactgaccgtcctaggtcagcccaaggctcgccccctcggtcacttctgtt

SEQ ID NO: 556313 - DNA, 483 bp, Homo sapiens; identical to SEQ ID NO: 535413
  misc_feature: HIJSMM301B4XSE.26.78.H01.1.454.light.4.raw

SEQ ID NO: 556314 - DNA, 486 bp, Homo sapiens; identical to SEQ ID NO: 535043
  misc_feature: HIJSMM301EYZW9.46.35.D02.1.454.light.4.raw

SEQ ID NO: 556315 - DNA, 490 bp, Homo sapiens; identical to SEQ ID NO: 535526
  misc_feature: HIJSMM301AMFON.26.78.H01.1.454.light.4.raw

SEQ ID NO: 556316 - DNA, 486 bp, Homo sapiens; identical to SEQ ID NO: 535043
  misc_feature: HIJSMM301ES9E1.46.35.D02.1.454.light.4.raw

SEQ ID NO: 556317 - DNA, 508 bp, Homo sapiens; identical to SEQ ID NO: 543419
  misc_feature: HIJSMM301CR7KW.4.10.A10.1.454.light.4.raw

SEQ ID NO: 556318 - DNA, 501 bp, Homo sapiens
  misc_feature: HIJSMM301D0E2M.48.30.C08.1.454.light.4.raw
agtatacatacacgaccggtgctcgatttagtctgacgtcaaagggaaagggggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagtttacgtcggaccttcggccaagggacacgactggagattaaacgaaactgtggctgcaccatctgtcttcatcttcccg

SEQ ID NO: 556319 - DNA, 501 bp, Homo sapiens; identical to SEQ ID NO: 535746
  misc_feature: HIJSMM301DGU9N.18.11.A11.1.454.light.4.raw

SEQ ID NO: 556320 - DNA, 447 bp, Homo sapiens; identical to SEQ ID NO: 535201
  misc_feature: HIJSMM301BQ8OZ.18.9.A09.1.454.light.4.raw

SEQ ID NO: 556321 - DNA, 444 bp, Homo sapiens; identical to SEQ ID NO: 535027
  misc_feature: HIJSMM301C0IE6.8.73.G07.1.454.light.4.raw

SEQ ID NO: 556322 - DNA, 494 bp, Homo sapiens; identical to SEQ ID NO: 536221
  misc_feature: HIJSMM301ESW9F.15.59.F04.1.454.light.4.raw

SEQ ID NO: 556323 - DNA, 493 bp, Homo sapiens
  misc_feature: HIJSMM301APU9B.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaggacggaggatcacgacgaaactgtggctgcaccatctgtcttcta

SEQ ID NO: 556324 - DNA, 484 bp, Homo sapiens; identical to SEQ ID NO: 535400
  misc_feature: HIJSMM301BT2W3.46.26.C04.1.454.light.4.raw

SEQ ID NO: 556325 - DNA, 494 bp, Homo sapiens; identical to SEQ ID NO: 540767
  misc_feature: HIJSMM301A6ZMM.11.81.H04.1.454.light.4.raw

SEQ ID NO: 556326 - DNA, 499 bp, Homo sapiens
  misc_feature: HIJSMM301E23BQ.14.55.E11.1.454.light.4.raw
  modified_base (425)..(425): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccncctctacgttcggcggacggacgacggacgagatacgagacgtactggtcgcgtcgaccactactctcgttctt

SEQ ID NO: 556327 - DNA, 494 bp, Homo sapiens; identical to SEQ ID NO: 534992
  misc_feature: HIJSMM301CK8UH.9.1.A01.1.454.light.4.raw

SEQ ID NO: 556328 - DNA, 504 bp, Homo sapiens
  misc_feature: HIJSMM301AJPOO.9.53.E09.1.454.light.4.raw
tgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggaccaaggtgaccgtcctaggtcagcccaaggctgtccccccg

SEQ ID NO: 556329 - DNA, 484 bp, Homo sapiens
  misc_feature: HIJSMM301EQJR9.5.45.E01.1.454.light.4.raw
atcagacacgcacgaccggtgctcgatttagtgagtcagtaagggaaaggggggagtcagacccagtcaggacacagcatggacatgagggtccccgctcagctcctggggctcctgctgctctggttcccaggttccagatgcgacatccagatgacccagtctccttctttcgtgtctgcgtctgtaggagacagacttactatcgcttgtcgggcgagtcaggatattagtaccaggttagcctggtatcagcagaagcctgggagagcccctaaactcctgatctatgctgcatcaagtctgcaaagtggggtcccatcgaggttcagaggcagtggatctgggacagatttcactctcaccatcagcggcctgcagcctgaagattatgcaacttactattgtcaaagttctaatgctttcccgcgcacgtttggccaggggaccaaggtagagatcaaacgaactgtggctgcaccat

SEQ ID NO: 556330 - DNA, 502 bp, Homo sapiens; identical to SEQ ID NO: 537816
  misc_feature: HIJSMM301EZDLX.19.78.H01.1.454.light.4.raw

SEQ ID NO: 556331 - DNA, 471 bp, Homo sapiens
  misc_feature: HIJSMM301ERSND.12.7.A07.1.454.light.4.raw
atacgacgtacacgaccggtgctcgatttagcacgtgtcgcagggggcaggagtcagacccactcaggacacagcatggacatgagggtccccgctcagctcctggggctcctgctgctctggctcccaggtgccacatgtgccatccagatgacccagtctccatcctccctgtctgcatctataggagacagagtcgccatcagttgccgggcaagtcagtacattagaaatgatttagcctggtatcagcagaaaccagggacagcccctcagctcctgatctatgctgcatccaatttacaaactggggtcccatcaaggttcagcggcagtggatctgcaacagacttcaatctcaccatcagcagcctgcagcctgaagattttgcaatttattactgtctgcaggattacacataccctcgaacgttcggccaagggaccaaggtggaaatacaaacgaactgt

SEQ ID NO: 556332 - DNA, 474 bp, Homo sapiens
  misc_feature: HIJSMM301COYER.41.8.A08.1.454.light.4.raw
tctatactatcacgaccggtgctcgatttagcatactctacagggggcaggagtcagacccagtcaggacacagcatggacatgagggtccccgctcagctcctggggctcctgctgctctggttcccaggttccagatgcgacatccagatgacccagtctccatcttccctgtctgcatctgtaggagacagagtcaccatcacttgtcgggcgagtcaggatattagcagctttttagcctggtatcagcagagaccagggaaagcccctaaactcctgatctatgctgcatccagtttgcaaagtgggtcccatcaaggttcagcggcagtggatctgggacagatttcactctcaccatcagcagcctgcagcctgacgattttgcaacttactattgtcaacaggctaacagtttcccgatgaccgtcggccaagggacacgactggacattaacgactgtggctgca

SEQ ID NO: 556333 - DNA, 441 bp, Homo sapiens; identical to SEQ ID NO: 534971
  misc_feature: HIJSMM301B2ANW.11.3.A03.1.454.light.4.raw

SEQ ID NO: 556334 - DNA, 493 bp, Homo sapiens; identical to SEQ ID NO: 535548
  misc_feature: HIJSMM301BCO40.51.81.H04.1.454.light.4.raw

SEQ ID NO: 556335 - DNA, 447 bp, Homo sapiens; identical to SEQ ID NO: 535201
  misc_feature: HIJSMM301DN6P8.18.9.A09.1.454.light.4.raw

SEQ ID NO: 556336 - DNA, 488 bp, Homo sapiens
  misc_feature: HIJSMM301DTV0T.48.75.G09.1.454.light.4.raw
agtatacatacacgaccggtgctcgatttagtatagacatcagggggatcaggacttctcagttcatcttctcaccatgaggctccctgctcagctcctggggctgctaatgctctggatccctggatccactgcgggtgttgtgttgacccaggctcccctgtctctgtccgtcacccctggacagccggccgccatgtcgtgcaattctagtcggagcctcttctatgaggacggcaggacctacttctattggtacatgcagaagccgggccggtctccacagctcctgatgtctgagatttccaggcgattccctggagtgccagagaggttcagtggcagcggagcagggacagagttcacactgaaaatcagccgggtggaggctgaggatgttggcctttattactgcatgcaaggtatcttcctcccatacacttttggcccggggaccaaggtggatctcaaagaactgtggctgcacc

SEQ ID NO: 556337 - DNA, 518 bp, Homo sapiens; identical to SEQ ID NO: 543797
  misc_feature: HIJSMM301AQRAX.19.80.H03.1.454.light.4.raw

SEQ ID NO: 556338 - DNA, 502 bp, Homo sapiens; identical to SEQ ID NO: 537816
  misc_feature: HIJSMM301C7XAM.19.78.H01.1.454.light.4.raw

SEQ ID NO: 556339 - DNA, 489 bp, Homo sapiens; identical to SEQ ID NO: 535139
  misc_feature: HIJSMM301CEO1U.14.55.E11.1.454.light.4.raw

SEQ ID NO: 556340 - DNA, 495 bp, Homo sapiens
  misc_feature: HIJSMM301CHN02.11.59.F04.1.454.light.4.raw
cgagagataccacgaccggtgctcgatttagtacacacacttagggattgggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagcccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctactctttctcttcggaactgggaccacggtcaccgtcctaggtcagcccaaggccaacccactgtcactctgttcccgccctctcgtatctctcg

SEQ ID NO: 556341 - DNA, 509 bp, Homo sapiens
  misc_feature: HIJSMM301BU9QP.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcgccaacgggaccgaaggtggaaagtacaaacgaaactagtggctgcaccactctgtcttctatcttccccg

SEQ ID NO: 556342 - DNA, 485 bp, Homo sapiens
  misc_feature: HIJSMM301CGGVS.10.1.A01.1.454.light.4.raw
catagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagctcctctccgacaggaataacatccggccctcagggatctcagagagattctctgcatccaggtcaggaagcacagcctccctgaccattactggactccaggctgacgacgaagctgattattactgctcagcatgggacaccggcctccagtgcgtgggttttcggcggagggaccaagctgaccgtcctaggtcagacccg

SEQ ID NO: 556343 - DNA, 503 bp, Homo sapiens; identical to SEQ ID NO: 537216
  misc_feature: HIJSMM301ATM0D.3.70.G04.1.454.light.4.raw

SEQ ID NO: 556344 - DNA, 493 bp, Homo sapiens
  misc_feature: HIJSMM301AMR8Q.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccagggttcagtggcagtgggtcggggtcagagttcactctcaccatcagcagcctgcagtctgaagattttgcagtttattactgtcagcagtatgatacctggcctccgtacacttttggccggggaccaagctggaaatcaagcgaactgtggctgcaccatctgtcttcatt

SEQ ID NO: 556345 - DNA, 493 bp, Homo sapiens
  misc_feature: HIJSMM301DUL96.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctcgtcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccagggtggagagtcagacgaactgtggctgcaccatctgtt

SEQ ID NO: 556346 - DNA, 503 bp, Homo sapiens
  misc_feature: HIJSMM301AH53P.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggtccgaacgggacgaaacgtaggacgatcaagacgaactagtggtcgtcgcgaccatctgtt

SEQ ID NO: 556347 - DNA, 489 bp, Homo sapiens; identical to SEQ ID NO: 535139
  misc_feature: HIJSMM301A51SL.14.55.E11.1.454.light.4.raw

SEQ ID NO: 556348 - DNA, 485 bp, Homo sapiens; identical to SEQ ID NO: 535880
  misc_feature: HIJSMM301DY3XW.7.75.G09.1.454.light.4.raw

SEQ ID NO: 556349 - DNA, 490 bp, Homo sapiens
  misc_feature: HIJSMM301CXNUF.15.59.F04.1.454.light.4.raw
tctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactacccagctggtaccaacagaccccaggccagcctccacgcacgctcatctatagcacaaacactcgctcttctgggtccctgatcgcttctctggctccatccttggaaacaagctgccctcaccatcacgggggcccaggcagatgatgaatctgtttattattgtgtcctatatatgggtgctggcatttcggtcttcggcggagggaccaagctgaccgtcctaggtcagcccaaggctgccccctcggtcacctgttcccaccctcctcgctacgtaga

SEQ ID NO: 556350 - DNA, 491 bp, Homo sapiens; identical to SEQ ID NO: 535194
  misc_feature: HIJSMM301CN2YB.26.78.H01.1.454.light.4.raw

SEQ ID NO: 556351 - DNA, 485 bp, Homo sapiens; identical to SEQ ID NO: 536263
  misc_feature: HIJSMM301ELE8N.47.78.H01.1.454.light.4.raw

SEQ ID NO: 556352 - DNA, 502 bp, Homo sapiens
  misc_feature: HIJSMM301EN2PW.14.57.F02.1.454.light.4.raw
cgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgcagtttattactgtcagcagcggggcaattggccgctcactttcggcgggggaccgaaggtggagttcaaacgaactgtggctgcaccatctgtcttcatcttccg

SEQ ID NO: 556353 - DNA, 478 bp, Homo sapiens
  misc_feature: HIJSMM301CNAIG.11.17.B06.1.454.light.4.raw
cgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccgggcaagtcagatcattagcagctatttaaattggtatcagcagaaaccagggaaagcccctgaggtcctgatctatgctgcatccagtttgcagagtggggtcccatcaaggttcagtggcagtggatctgcgacagatttcactctcaccatcagcagtctgcaacctgaagattttgcaacttactactgtcaacagagttacagtaccccgtggacgttcggccaagggaccaaggtggaaatcaaacgaactgtggctgcaa

SEQ ID NO: 556354 - DNA, 510 bp, Homo sapiens; identical to SEQ ID NO: 553863
  misc_feature: HIJSMM301CV9PQ.16.46.E02.1.454.light.4.raw

SEQ ID NO: 556355 - DNA, 380 bp, Homo sapiens
  misc_feature: HIJSMM301DBCY3.12.14.B03.1.454.light.4.raw
atacgacgtacacgaccggtgctcgatttagtgtgagtagtttgagtttgggggccgttcctggaagcagctccaacatcggaagtaatactgtaaactggtaccagcagctcccaggaacggcccccaaactcctcatctatagtaataatcagcgaccctcaggggtccctgaccgattctctggctccaagtctggcacctcagcctccctggccatcagtgggctccagtctgaggatgaggctgattattactgtgcagcatgggatgacagcctgaatggtccggtattcggcggagggaccaagctgaccgtcctaggtcagcccaaggctgccccctcggtcactctgttcccatcctcctctacgtcgtat

SEQ ID NO: 556356 - DNA, 503 bp, Homo sapiens; identical to SEQ ID NO: 543363
  misc_feature: HIJSMM301DL4P8.19.78.H01.1.454.light.4.raw

SEQ ID NO: 556357 - DNA, 485 bp, Homo sapiens
  misc_feature: HIJSMM301D1FJN.4.41.D08.1.454.light.4.raw
agcactgtagcacgaccggtgctcgatttagtcacgcgagaaagggaaaggggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcgggcgagtcaggatattagtaccaacttagcctggtatcagcagaagcctgggcgagcccctaaactcctgatctatggtgcatcaagtctgcaaagtggggtcccatcgaggttcagaggcagtggatctgggacagattttcactctcaccatcagcggcctgcagcctgaagattatgcaacttactattgtcagagttctaattctttcccgcgcacgtttggccaggggacccaaggtagagatcaaacgaactgtggctgcaccat

SEQ ID NO: 556358 - DNA, 486 bp, Homo sapiens; identical to SEQ ID NO: 535043
  misc_feature: HIJSMM301CP0LO.46.35.D02.1.454.light.4.raw

SEQ ID NO: 556359 - DNA, 492 bp, Homo sapiens
  misc_feature: HIJSMM301DPEMG.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggcgggggaccaaggtggagttcaacgaactgtggctgcaccatctgtcttcat

SEQ ID NO: 556360 - DNA, 473 bp, Homo sapiens
  misc_feature: HIJSMM301AQV4C.48.75.G09.1.454.light.4.raw
agtatacatacacgaccggtgctcgatttagtatagacatcagggggatcaggacttctcagttcatcttctcaccatgaggctccctgctcagctcctggggctgctaatgctctggatccctggatccactgcgggtgttgtgttgacccaggctcccctgtctctgtccgtcacccctggacagccggccgccatgtcgtgcaattctagtcggagcctcttctatgaggacggcaggacctacttctattggtacatgcagaagccgggccggtctccacagctcctgatgtctgagatttccaggcgattccctggagtgccagagaggttcagtggcagcggagcagggacagagttcacactgaaaatcagccgggtggaggctgaggatgttggcctttattactgcatgcaaggaactgtggctgcaccatctgtcttcatcttcccgccatctgatatgtata

SEQ ID NO: 556361 - DNA, 509 bp, Homo sapiens; identical to SEQ ID NO: 539359
  misc_feature: HIJSMM301EFQ11.47.85.H08.1.454.light.4.raw

SEQ ID NO: 556362 - DNA, 489 bp, Homo sapiens; identical to SEQ ID NO: 541346
  misc_feature: HIJSMM301BEZ2L.13.87.H10.1.454.light.4.raw

SEQ ID NO: 556363 - DNA, 496 bp, Homo sapiens
  misc_feature: HIJSMM301B8P7T.9.53.E09.1.454.light.4.raw
tgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggcctcaggggtttctattcgcttctctggctccaagtctgacaacacggcctccctgacaatctctgggctccaggctgaggacgaggctgattattactgctgctcatatgcagatggtgacactcccgtggtattcggcggagggaccaaggtgaccgtcctaggtcagcccaaggctg

SEQ ID NO: 556364 - DNA, 504 bp, Homo sapiens; identical to SEQ ID NO: 536385
  misc_feature: HIJSMM301E0Z2U.27.78.H01.1.454.light.4.raw

SEQ ID NO: 556365 - DNA, 513 bp, Homo sapiens; identical to SEQ ID NO: 535244
  misc_feature: HIJSMM301BBIPC.17.33.C11.1.454.light.4.raw

SEQ ID NO: 556366 - DNA, 454 bp, Homo sapiens; identical to SEQ ID NO: 536347
  misc_feature: HIJSMM301BCCKZ.19.86.H09.1.454.light.4.raw

SEQ ID NO: 556367 - DNA, 514 bp, Homo sapiens
  misc_feature: HIJSMM301BDL4E.51.9.A09.1.454.light.4.raw
cgatcgtatacacgaccggtgctcgatttagcgagacgcgcaggggactgcgggggtaagaggttgtgtccaccatggcctggactcctctcctcctcctgttcctctctcactgcacaggttccctctcgcaggctgtgctgactcagccgtcttccctgtctgcatctcctggagcatcagccagtctcacctgcaccttgcgcagtggcttcgatgttagtacctacaggatatactggttccagcagaaggcagggagtcctccccagtttctcctaaattacaaatctgactcacgtaagcagcagggctctggagtccccagccgcttctctggatccaaagatgcttcggccaatgcggggagttttactcatctctgggctccagtctgaggatgaggctgactatttactgtttgtatttggtcgacagcagcgcttgggtagttcggcggggggaccggaaacctagccgtacctacgtcgacgccacggacgtcgtccccccg

SEQ ID NO: 556368 - DNA, 488 bp, Homo sapiens
  misc_feature: HIJSMM301CSB0K.41.33.C11.1.454.light.4.raw
tctatactatcacgaccggtgctcgatttagagtgagctcgttgggtttgggggaggaactgctcagttaggacccagacggaaccatggaagccccagcgcagcttctcttcctcctgctactctggctcccagataccactgcagaaatactgatgacgcagtctccagccaccctgtctgtgtctccaggagaaagagtcaccctctcctgcagggccagtcagagtgctggcagcaacttagcctggtatcagcagaaacctggccaggctcccaggctcctcatctctggtgcttccacccgggacactggtatcccagccaggttcagtggcagtgggtctgggacagagttcactctcaccatcagcactctacagtctgaggattatgcagttttactactgtctgcagtataaagactggcctagggtcactttcggccctgggaccaaagtggatttacaaacgaactgtgctgcacc

SEQ ID NO: 556369 - DNA, 494 bp, Homo sapiens; identical to SEQ ID NO: 534992
  misc_feature: HIJSMM301EK3XD.9.1.A01.1.454.light.4.raw

SEQ ID NO: 556370 - DNA, 505 bp, Homo sapiens; identical to SEQ ID NO: 536117
  misc_feature: HIJSMM301DGJDI.8.71.G05.1.454.light.4.raw

SEQ ID NO: 556371 - DNA, 512 bp, Homo sapiens; identical to SEQ ID NO: 539198
  misc_feature: HIJSMM301BQCOI.17.33.C11.1.454.light.4.raw

SEQ ID NO: 556372 - DNA, 488 bp, Homo sapiens; identical to SEQ ID NO: 538811
  misc_feature: HIJSMM301D26JS.40.83.H06.1.454.light.4.raw

SEQ ID NO: 556373 - DNA, 485 bp, Homo sapiens
  misc_feature: HIJSMM301D3AHT.4.8.A08.1.454.light.4.raw
agcactgtagcacgaccggtgctcgatttagcatactctacaggggctgggcctcaggaagcagcatcggaggtgcctcagccatggcatggatccctctcttcctcggcgtccttgcttactgcacaggatccgtgccctcctatgaactgactcagccaccgtcagtgtccgtgtccccaggacagacagccagcattagttgctctggagatagattggagaataaatttgttacctggtatcagcagaagccaggccagtcccctgtgctggtcatctatcaggataaggagcggccctcagggatccctgagcgaatctctggctccaactctgggaacacagccactctgaccatcagcgggacccaggctatggatgagggtgactattactgtcaggcgtgggacagcccttatgtggtattcggcggagggaccaagctgaccgtcctaggtcagcccaaggctcgccccctcggt

SEQ ID NO: 556374 - DNA, 467 bp, Homo sapiens
  misc_feature: HIJSMM301BMR0B.18.78.H01.1.454.light.4.raw
tacgagtatgcacgaccggtgctcgatttagtgtgagtagtttgggtttgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccaccctcctccatactcgta

SEQ ID NO: 556375 - DNA, 478 bp, Homo sapiens
  misc_feature: HIJSMM301DF7WZ.52.1.A01.1.454.light.4.raw
cgcagtacgacacgaccggtgctcgatttagacgtctcatcaggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtggggtcccatcaaggttcagtggcagtggatctgggacagaattcactctcaccatcaccagtctgcaggctgaggattttgcaacttacttctgtcaacagagttacagttccctcactttcggccctgggacccatagtggatatcaaacgaactgtggctgcaccatctgt

SEQ ID NO: 556376 - DNA, 503 bp, Homo sapiens
  misc_feature: HIJSMM301BMRV3.48.38.D05.1.454.light.4.raw
agtatacatacacgaccggtgctcgatttagtatctgatagttgggtttggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcaccatctgtcttcatcttccccg

SEQ ID NO: 556377 - DNA, 480 bp, Homo sapiens
  misc_feature: HIJSMM301DDGZW.40.59.F04.1.454.light.4.raw
tctagcgactcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccgaagctgaccgtcctaagtcagacccg

SEQ ID NO: 556378 - DNA, 473 bp, Homo sapiens; identical to SEQ ID NO: 538060
  misc_feature: HIJSMM301D2VJG.18.76.G10.1.454.light.4.raw

SEQ ID NO: 556379 - DNA, 489 bp, Homo sapiens
  misc_feature: HIJSMM301A9QKR.4.72.G06.1.454.light.4.raw
agcactgtagcacgaccggtgctcgatttagctacgactgcaagggaaagggggaggaactgctcagttaggacccagacggaaccatggaagccccagcgcagcttctcttcctcctgctactctggctcccagaaagcagtggagaagtagtgatgacgcagtctccagccaccctgcctgtgtctccaggggacactgccaccctctcctgcagggccagtcagagtgttggcactaatttagcctggtaccagcagaaacctggccaagctcccaggctgctcatctataatacaatcacaagggacattggtgtcccagacaggttcagcggcagtgggtctgggacagagttcactctcactatcagcagcctgcactttgaagtattttgcagtctatcattgtcagcagtataattggtggcctcggacgttcgccgacggacgaacggtaggaatacaaacgaactagtggctgcaccat

SEQ ID NO: 556380 - DNA, 506 bp, Homo sapiens
  misc_feature: HIJSMM301APII5.2.71.G05.1.454.light.4.raw
acgctcgacacacgaccggtgctcgatttagtgtcgtcgcaagagagaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaggacaggcccctgtaattgtcatctatggaatctatggtaaaaacaaccggccctcagggatcccagaccgattctctggctcctactcaggaaacacagcttccttgacccatcactggggctcaggcggaagatgaggctgactattattgtaagtccggggacagaagtggtaattacatggtgttcggcggagggaccaagctgaccgtcctacgtcagccaaggctgccccctcggtcactc

SEQ ID NO: 556381 - DNA, 471 bp, Homo sapiens; identical to SEQ ID NO: 540579
  misc_feature: HIJSMM301BKLHE.3.82.H05.1.454.light.4.raw

SEQ ID NO: 556382 - DNA, 523 bp, Homo sapiens
  misc_feature: HIJSMM301CB68B.49.27.C05.1.454.light.4.raw
agtcgagagacacgaccggtgctcgatttagacgcgatcgaagggtttgggggtgggtccaggaggcagaactctgggtgtctcaccatggcctggatccctctacttctccccctcctcactctctgcacaggctctgaggcctcctatgagttgatccagccaccctcggtgtcagtgtccccaggacagacggccaggattctttgctctggagatgcgttggcaaaacagtttgcttattggttccagcagaagccaggccaagcccctgtggtggtgatttataaaggctttcagaggccctcagggatccctgagcgattctctgggtccagctcagggacaacagccatgttgaccatcagtggagtccagcagaagacgaggctgactattattgtcaatcagcagacaacactgttgtttctgtgtttttcggtcggcgggaccgacggcgtgaccgtccctgggttcacgcccaaggcgtgccccctccggtcgactctggttcccacccctt

SEQ ID NO: 556383 - DNA, 514 bp, Homo sapiens
  misc_feature: HIJSMM301CKH3I.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccgccctcctcc

SEQ ID NO: 556384 - DNA, 493 bp, Homo sapiens; identical to SEQ ID NO: 537422
  misc_feature: HIJSMM301DHIEB.9.34.D01.1.454.light.4.raw

SEQ ID NO: 556385 - DNA, 473 bp, Homo sapiens; identical to SEQ ID NO: 546369
  misc_feature: HIJSMM301COJLU.18.76.G10.1.454.light.4.raw

SEQ ID NO: 556386 - DNA, 493 bp, Homo sapiens; identical to SEQ ID NO: 535084
  misc_feature: HIJSMM301AVW4O.47.64.F09.1.454.light.4.raw

SEQ ID NO: 556387 - DNA, 512 bp, Homo sapiens
  misc_feature: HIJSMM301EVLLB.48.53.E09.1.454.light.4.raw
agtatacatacacgaccggtgctcgatttagagagagtgtgttgggtttgggggtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctgttcccgccct

SEQ ID NO: 556388 - DNA, 518 bp, Homo sapiens
  misc_feature: HIJSMM301BOEIP.17.37.D04.1.454.light.4.raw
cgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccagggcagacggccaggattacctgtgggggaaacaatgttggaagtaaaactgtgcactggtaccagcagaagccaggccaggcccctgtgctggtcgtctatgatgataccgaccggccctcagggatccctgagcgattctctggctccaactctgggaacacggccaccctgaccatcggcagggtcgaagccggggatgaggccgactattattgtcaggtgtggggatagtagtagtgatcatgtggtattcggcggagggaccaagctgaccgtccttggtcagcccaaggctgccccctcggtcactttgttcccgccctcct

SEQ ID NO: 556389 - DNA, 506 bp, Homo sapiens; identical to SEQ ID NO: 534969
  misc_feature: HIJSMM301D1HJU.18.37.D04.1.454.light.4.raw

SEQ ID NO: 556390 - DNA, 447 bp, Homo sapiens; identical to SEQ ID NO: 535020
  misc_feature: HIJSMM301AGHNB.18.9.A09.1.454.light.4.raw

SEQ ID NO: 556391 - DNA, 501 bp, Homo sapiens; identical to SEQ ID NO: 536818
  misc_feature: HIJSMM301B0GGZ.12.82.H05.1.454.light.4.raw

SEQ ID NO: 556392 - DNA, 494 bp, Homo sapiens; identical to SEQ ID NO: 539922
  misc_feature: HIJSMM301ATRDN.27.78.H01.1.454.light.4.raw

SEQ ID NO: 556393 - DNA, 504 bp, Homo sapiens
  misc_feature: HIJSMM301EKS3M.48.55.E11.1.454.light.4.raw
agtatacatacacgaccggtgctcgatttagcactcgcacgttgggtttggggaggaactgctcagttaggacccagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggctcctcatttatgatacatccaccagggccactggtgtcccagccaggttcactggcggtgggtctgggacagagttcactctcaccatcagcagcctgcagtctgaagattttacattttattactgtcagcagtatcgtaagtggactccgacgtttggccaagggaccaaggtggaagtcaaacgaactgtggctgcaccatctgtcttcatcttcccgcc

SEQ ID NO: 556394 - DNA, 488 bp, Homo sapiens; identical to SEQ ID NO: 535081
  misc_feature: HIJSMM301C6W1U.26.23.C01.1.454.light.4.raw

SEQ ID NO: 556395 - DNA, 519 bp, Homo sapiens
  misc_feature: HIJSMM301BAKUK.48.14.B03.1.454.light.4.raw
agtatacatacacgaccggtgctcgatttagtgtgagtagttccgcgggggatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaagtaaaaatggaaacatttacttacattggtttcaacagaggccaggccagtctccaaggcgcctgatttatgacgtttttaaacgggagtctggggtcccagacagattcagcggcagtgggtcagacactgacttcacactgagaatcagcagggttgaggctgaggatgttggcacttattactgcatgcaaggctcacactggcctccgtggacgttcggccaagggacccggtaggaaagtaaaacgaaactagtggctgcaccatctgtcttcatcttccccg

SEQ ID NO: 556396 - DNA, 500 bp, Homo sapiens
  misc_feature: HIJSMM301ELYEP.41.18.B07.1.454.light.4.raw
tctatactatcacgaccggtgctcgatttagtcgctgcgtaagggggggagcctagctgtggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcgagggatccctgagcgattctctggcgccagctcaggaacagtagtcacgttgacatcagtggagtccaggcagaagacgaggctgactattattgtcaagcagtagacagcagtggtccttagtcgggtgttcggcggggggaccaaggctgaccgtctaggtcagcccaaggctcccgg

SEQ ID NO: 556397 - DNA, 494 bp, Homo sapiens; identical to SEQ ID NO: 534992
  misc_feature: HIJSMM301ATVUV.9.1.A01.1.454.light.4.raw

SEQ ID NO: 556398 - DNA, 463 bp, Homo sapiens
  misc_feature: HIJSMM301BDGH7.49.4.A04.1.454.light.4.raw
agtcgagagacacgaccggtgctcgatttagagtagtgatcaggggcagtcccaaccaggacacagcatggacatgagggtccctgctcagctcctggggctcctgctgctctggctctcaggtgccagatgtgtcatccagatgacccagtctccttcctccctgtctgcatctataggagacagaatcaccatcacttgccgggcgagtcgagacattagcatgtatctgaattggtatcagcaaaaaccagggacagcccctaaactcctgatcctcgatgcatccactttggagacaggggtcccatcaaggttcagtggaagtggctctgggacagattttactttcaccatcagcaggctgcagcctgaagatattgcaacatattactgtcaacagtatgatcgcctcccgctcactttcggcgggggaccaaggtggagatcaagcgaactgtgg

SEQ ID NO: 556399 - DNA, 504 bp, Homo sapiens
  misc_feature: HIJSMM301EV9R0.9.71.G05.1.454.light.4.raw
tgatacgtctcacgaccggtgctcgatttagtgtcgtcgcaagagagagggggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcggagggaccaggctgaccgtcctgagtcagcccaaggctgccccctcggtcactctgttcccaccctcctcacg

SEQ ID NO: 556400 - DNA, 510 bp, Homo sapiens; identical to SEQ ID NO: 542037
  misc_feature: HIJSMM301AKBIG.4.57.F02.1.454.light.4.raw

SEQ ID NO: 556401 - DNA, 517 bp, Homo sapiens
  misc_feature: HIJSMM301BX9TD.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccaaggtgcgaatcaaccgaactgtggctgcaccatctgtcttcatctccccg

SEQ ID NO: 556402 - DNA, 497 bp, Homo sapiens
  misc_feature: HIJSMM301CK5WX.43.34.D01.1.454.light.4.raw
tgtgagtagtcacgaccggtgctcgatttagatcgtctgtgttgggtttgggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattggacgacggtcaccgtcctaggtcagcccaaggccaaccca

SEQ ID NO: 556403 - DNA, 488 bp, Homo sapiens; identical to SEQ ID NO: 535990
  misc_feature: HIJSMM301EGGXL.11.28.C06.1.454.light.4.raw

SEQ ID NO: 556404 - DNA, 484 bp, Homo sapiens; identical to SEQ ID NO: 538870
  misc_feature: HIJSMM301ELQBF.11.76.G10.1.454.light.4.raw

SEQ ID NO: 556405 - DNA, 485 bp, Homo sapiens
  misc_feature: HIJSMM301CEO8N.26.45.E01.1.454.light.4.raw
agactatactcacgaccggtgctcgatttagtgagtcagtaagggaaaggggtgatcaggactcctcagttcaccttctcacaatgaggctccctgctcagctcctggggctgctaatgctctgggtctctggatccagtggagatattgtgatggctcagtctccactctccctgcccgtcacccctggagagccggcctccatctcctgcaggtctagtcagagcgtcctgcatagtagtggatacaactatttggattggtacctgcagaagccagggcagtctccacagctcctgatctatttggcttctaatcgggcctccggggtccctgacaggttcagtggcagtggatcagacacagattttacactgaaaatcagtagagtggaggctgaggatgttggagtttattactgcatgcaagctctacaaactcctctcactttcggcgagggccaaggtggagatcaaacgaactgt

SEQ ID NO: 556406 - DNA, 489 bp, Homo sapiens; identical to SEQ ID NO: 543840
  misc_feature: HIJSMM301A5B0D.12.88.H11.1.454.light.4.raw

SEQ ID NO: 556407 - DNA, 505 bp, Homo sapiens
  misc_feature: HIJSMM301D58P9.9.12.B01.1.454.light.4.raw
  modified_base (429)..(429): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttcncgggcgttgccaaggaccgaaggtaggaaatacaaaacgaactagtggctgcaccatctgtcttctatcttccccg

SEQ ID NO: 556408 - DNA, 460 bp, Homo sapiens; identical to SEQ ID NO: 536053
  misc_feature: HIJSMM301EDYHM.22.28.C06.1.454.light.4.raw

SEQ ID NO: 556409 - DNA, 484 bp, Homo sapiens
  misc_feature: HIJSMM301AV6ZU.13.6.A06.1.454.light.4.raw
tcacgtactacacgaccggtgctcgatttagatctactgacaggggggggtcgtcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacaacacccaggcaaagcccccaaaatcatgatttatgatgtcagtaagcggccctcaggggtccctgatcgcttctctgcctccaagtctggcaacacggcctccctgaccatctctgggctccaggctgaggatgagtctgattattactgctgctcatatgcaggcagctacactgtactattcggcggagggaccaagctgaccgtcctaggtcagcccaac

SEQ ID NO: 556410 - DNA, 483 bp, Homo sapiens; identical to SEQ ID NO: 535317
  misc_feature: HIJSMM301C9AB2.4.1.A01.1.454.light.4.raw

SEQ ID NO: 556411 - DNA, 496 bp, Homo sapiens; identical to SEQ ID NO: 535109
  misc_feature: HIJSMM301ANEID.16.78.H01.1.454.light.4.raw

SEQ ID NO: 556412 - DNA, 486 bp, Homo sapiens
  misc_feature: HIJSMM301EJ9M9.17.26.C04.1.454.light.4.raw
cgtagactagcacgaccggtgctcgatttagtctagcgactttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttcagtggcagtggatctgggacagatttcactctcaccatcagcagtctgcaacctgaagattttgcaacttactactgtcaacagagttacaatacccctcggctcactttcggcggagggaccgaaggtggaggatcaaacgaaactagtggctgcaccat

SEQ ID NO: 556413 - DNA, 508 bp, Homo sapiens
  misc_feature: HIJSMM301D0H13.40.18.B07.1.454.light.4.raw
tctagcgactcacgaccggtgctcgatttagtcgctgcgtaagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggccaaccccactgtcactctgtt

SEQ ID NO: 556414 - DNA, 486 bp, Homo sapiens; identical to SEQ ID NO: 553608
  misc_feature: HIJSMM301DFLFA.11.12.B01.1.454.light.4.raw

SEQ ID NO: 556415 - DNA, 494 bp, Homo sapiens
  misc_feature: HIJSMM301A5DRC.43.60.F05.1.454.light.4.raw
tgtgagtagtcacgaccggtgctcgatttagtacgtcatcagggaaaggggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcggtccacgggaccgacggtcggagtgtctaagcgaacgtgtggctgcaccactctcg

SEQ ID NO: 556416 - DNA, 493 bp, Homo sapiens; identical to SEQ ID NO: 535745
  misc_feature: HIJSMM301D3YCD.47.78.H01.1.454.light.4.raw

SEQ ID NO: 556417 - DNA, 454 bp, Homo sapiens; identical to SEQ ID NO: 534964
  misc_feature: HIJSMM301DOTSI.19.86.H09.1.454.light.4.raw

SEQ ID NO: 556418 - DNA, 500 bp, Homo sapiens
  misc_feature: HIJSMM301A0DPP.3.33.C11.1.454.light.4.raw
agacgcactccacgaccggtgctcgatttagagtgagctcgttgggtttggggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctgttaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgacgtccctaggtcagcccaaggctcgccccccg

SEQ ID NO: 556419 - DNA, 399 bp, Homo sapiens
  misc_feature: HIJSMM301C8EA0.8.53.E09.1.454.light.4.raw
ctcgcgtgtccacgaccggtgctcgatttagagagagtgtgttgggtttgggggtgtggtggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgttccaccctcctcgacacgcgag

SEQ ID NO: 556420 - DNA, 494 bp, Homo sapiens
  misc_feature: HIJSMM301DERY3.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgcctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatctgtcttcatcttccccg

SEQ ID NO: 556421 - DNA, 496 bp, Homo sapiens
  misc_feature: HIJSMM301AMRG2.52.55.E11.1.454.light.4.raw
cgcagtacgacacgaccggtgctcgatttagcactcgcacgttgggtttggggggaactgctcagttaggacccagagggaaccatggaagccccagctcagcttctcttcctcctgctactctggctcccagataccaccggagaagttgtattgacacagtctccagccaccctgtctttgtctccaggggggagagccaccctctcctgcagggccagtcagagtgttggcaacctcttagcctggtaccaacaaaacctggccaggctcccaggctcctcatctatgatgcatccacgagggccactggcatcccagccaggttcagtggcagtgggtctgagacagacttcactctcaccatcagtggcctcgagcctgaagattttgcagtttattactgtcagcagcgtagccactggctctctttcggcggaggaccaaggttgagatcaaacgaactgtggctgcaccatctgtcttcatcttcccg

SEQ ID NO: 556422 - DNA, 497 bp, Homo sapiens
  misc_feature: HIJSMM301AXXCJ.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctactcttttctcttcggaactgggaccacggtcaccgtcctaggtcagccccaaggcccaacccc

SEQ ID NO: 556423 - DNA, 475 bp, Homo sapiens; identical to SEQ ID NO: 550613
  misc_feature: HIJSMM301DIRT7.43.76.G10.1.454.light.4.raw

SEQ ID NO: 556424 - DNA, 510 bp, Homo sapiens; identical to SEQ ID NO: 535474
  misc_feature: HIJSMM301BY3QS.17.33.C11.1.454.light.4.raw

SEQ ID NO: 556425 - DNA, 496 bp, Homo sapiens; identical to SEQ ID NO: 536248
  misc_feature: HIJSMM301E1VCV.22.27.C05.1.454.light.4.raw

SEQ ID NO: 556426 - DNA, 505 bp, Homo sapiens
  misc_feature: HIJSMM301C6J62.40.23.C01.1.454.light.4.raw
  modified_base (201)..(201): a, c, t, g, unknown or other
tctagcgactcacgaccggtgctcgatttagtacacgtgattagggattgggggaggaactgctcagttaggacccagagggaaccatggaagccccagctcagcttctcttcctcctgctactctggctcccagactaccaccggagaaattgtgttgacacagtctccagccacccttgtctttgtctccaggggaaanagccaccctctcctgcagggccagtcagagtcttagcaactacttagtctggtaccaacagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaaggacacgactggagattaaccgaactgtggctgcaccatctgtcttcatcttccccg

SEQ ID NO: 556427 - DNA, 486 bp, Homo sapiens
  misc_feature: HIJSMM301ADO1A.17.26.C04.1.454.light.4.raw
cgtagactagcacgaccggtgctcgatttagtctagcgactttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttcagtggcagtggatctgggacagatttcactctcaccatcagcagtctgcaacctgaagattttgcaacttactactgtcaacagagttacaatacccctcggctcactttcggcggagggaccgaaggtggagatcaaacgaaactagtggctgcaccact

SEQ ID NO: 556428 - DNA, 513 bp, Homo sapiens
  misc_feature: HIJSMM301DIGJ3.15.34.D01.1.454.light.4.raw
tctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtggggcgtggcatttgggtgttcggcggagggaccaaactgaccgtcctaggtcagcccaaggctgccccctggtcactctcg

SEQ ID NO: 556429 - DNA, 482 bp, Homo sapiens; identical to SEQ ID NO: 535920
  misc_feature: HIJSMM301B8H8M.19.71.G05.1.454.light.4.raw

SEQ ID NO: 556430 - DNA, 472 bp, Homo sapiens; identical to SEQ ID NO: 536302
  misc_feature: HIJSMM301B2EAO.18.76.G10.1.454.light.4.raw

SEQ ID NO: 556431 - DNA, 494 bp, Homo sapiens; identical to SEQ ID NO: 534992
  misc_feature: HIJSMM301C365P.9.1.A01.1.454.light.4.raw

SEQ ID NO: 556432 - DNA, 496 bp, Homo sapiens
  misc_feature: HIJSMM301C5MYT.3.71.G05.1.454.light.4.raw
  modified_base (427)..(427): a, c, t, g, unknown or other
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaccggccctcagggatcccagaccgattctctggctccagctcaggaaacacagcttccttgaccatcactggggctcaggcggaagatgaggctgactattactgtaactccgggccagcagtggtaacattgngatattcggcggagggaccaaggtgaccgtcctacgtcagcccaaggctgccccctcggtcactctccg

SEQ ID NO: 556433 - DNA, 489 bp, Homo sapiens
  misc_feature: HIJSMM301C21XL.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctactactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccagggaccaagctggagatcaaacgaactgtggctgcaccatctgt

SEQ ID NO: 556434 - DNA, 464 bp, Homo sapiens
  misc_feature: HIJSMM301CC70I.51.16.B05.1.454.light.4.raw
  modified_base (428)..(428): a, c, t, g, unknown or other
cgatcgtatacacgaccggtgctcgatttagagctcacgtaaggggaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatctcttgccaggcgagtcaggacattataagatatttaaattggtatcagcagaaaccagggaaagcccctaagctcctgatctacgatgcatccaatttggaaacaggggtcccatcaaggttcagtggaagtggatctgggacagtattttactttcaccatcagcagcctgcagcctgaggatcttgcaacatattactgtcaacagtatgataatgtcccgtanacttttggccagggaccaagctggagatcagacgaa

SEQ ID NO: 556435 - DNA, 478 bp, Homo sapiens
  misc_feature: HIJSMM301CJ49I.48.73.G07.1.454.light.4.raw
agtatacatacacgaccggtgctcgatttagctctacgctcagggcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcagggctgactcagccaccctcggtgtccaagggcttgagacagaccgccacaatcacctgcactgggaacaacaataatgtcgccaaccaaggagcagcttggctgcagcagcaccagggccaccctcccaaagtcgtatccgacagggataacaatcggcccttagggatctcagagagaatatctgcatccaggtcaggaaacacagcctccctgaccattactggactccaacctgaggacgaggctgactattattgctcagcatgggacaccagcctcaatgccgtc

SEQ ID NO: 556436 - DNA, 484 bp, Homo sapiens
  misc_feature: HIJSMM301CVPHM.22.6.A06.1.454.light.4.raw
acatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgccaaatcaatatgctttttggtatcaacagaggccaggccacgcccctgtcttaatgatatataaagacagtgagaggccctcagggatctctgagcgattctctgcctccagctcagggacaacattcacattgaccatcagtgaagtccaggcagaagatgaggctgactattattgtcaatcaacagacagtagtgggaaatatgtggtattcggcggagggaccaaactgaccgtcctaggtcagcccaaggctgcccccg

SEQ ID NO: 556437 - DNA, 494 bp, Homo sapiens; identical to SEQ ID NO: 542031
  misc_feature: HIJSMM301EJJ4A.12.23.C01.1.454.light.4.raw

SEQ ID NO: 556438 - DNA, 496 bp, Homo sapiens; identical to SEQ ID NO: 542070
  misc_feature: HIJSMM301B1M8P.22.14.B03.1.454.light.4.raw

SEQ ID NO: 556439 - DNA, 484 bp, Homo sapiens; identical to SEQ ID NO: 535240
  misc_feature: HIJSMM301B4V1Q.47.60.F05.1.454.light.4.raw

SEQ ID NO: 556440 - DNA, 500 bp, Homo sapiens
  misc_feature: HIJSMM301B6RR8.14.3.A03.1.454.light.4.raw
cgtctagtaccacgaccggtgctcgatttagagagcgtcacaggggggatctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctggtaccaacagcacccaggcaaagcccccaaactcattatttatgaggtcaataatcggccctcaggagtttctaatcgcttctctggctccaagtctggcaacacggcctccctgagcatctctgggctccaggctgaggacgaggctgattattactgcagctcatatactattagcagaactgtggttttcggcggagggaccaaggtgaccgtcctaggtcagcccaaggctgccccctcggtcact

SEQ ID NO: 556441 - DNA, 485 bp, Homo sapiens
  misc_feature: HIJSMM301A6RAZ.48.86.H09.1.454.light.4.raw
agtatacatacacgaccggtgctcgatttagtgctatagacttgggtttgggggaaccatggaagccccagcgcagcttctcttcctcctgctactctggctcccagaaagcaccggagacattgaactgacgcagtctccaggcaccctgtctttgtctccaggggaaagagccaccctctcctgcagggccggtcggagtctttccagcacctacttagcctggtaccaacaaaaagctggccaggctcccaggctcctcatatatgatgtttctaccagggccactggcattccagacaggttcagtggcagtgggtctgggacagacttcactctcaccatcaacagattggagcctgaagactctgcagtctatttctgtcagcaatatcgcagttcagtctcgtacacttttggccaggggaccacgctggagatcaaacgaactgtggctgcaccatctgtcttcatcttcccgccat

SEQ ID NO: 556442 - DNA, 475 bp, Homo sapiens
  misc_feature: HIJSMM301DNQVO.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattacttattgccagtccatgacaacaccctgctggttttggctgttcgcggcgg

SEQ ID NO: 556443 - DNA, 503 bp, Homo sapiens; identical to SEQ ID NO: 538884
  misc_feature: HIJSMM301BBCEV.27.78.H01.1.454.light.4.raw

SEQ ID NO: 556444 - DNA, 301 bp, Homo sapiens
  misc_feature: HIJSMM301DCIC0.13.11.A11.1.454.light.4.raw
tcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcactttattctgtcaccagtatggaactgtggctgcaccatctgtcttcatcttcccgccatctgatagtacgtga

SEQ ID NO: 556445 - DNA, 520 bp, Homo sapiens; identical to SEQ ID NO: 537173
  misc_feature: HIJSMM301CPRT5.27.23.C01.1.454.light.4.raw

SEQ ID NO: 556446 - DNA, 459 bp, Homo sapiens; identical to SEQ ID NO: 555098
  misc_feature: HIJSMM301ANYV3.22.28.C06.1.454.light.4.raw

SEQ ID NO: 556447 - DNA, 514 bp, Homo sapiens; identical to SEQ ID NO: 546238
  misc_feature: HIJSMM301DW4C4.47.85.H08.1.454.light.4.raw

SEQ ID NO: 556448 - DNA, 476 bp, Homo sapiens
  misc_feature: HIJSMM301CMT3K.41.39.D06.1.454.light.4.raw
tctatactatcacgaccggtgctcgatttagtgacatctcgcagttctttggggagagctgctcagttaggacccagagggaaccatggaaaccccagcgcagcttctcttcctcctgctactctggctcccagataccaccgaagaaattgtgttgacgcagtctccaggcaccctgtctttgtctccaggagaaagagccaccctctcctgtagggccagtcagattgttagcagcggctacttagcctggttccagcagagacctggccaggctcccaggctcctcatctatgaagcgtccatcaggcccactggcatcccagacagattcagtggcagtgggtctgggacagacttcactctcaccatcagcggactggagcctgaagattttgcagtctattactgtcagcagtatggtggctcacctccgtacacctttggccaggggaccaagctggagatcaaacgaa

SEQ ID NO: 556449 - DNA, 518 bp, Homo sapiens; identical to SEQ ID NO: 539372
  misc_feature: HIJSMM301AUIPE.7.86.H09.1.454.light.4.raw

SEQ ID NO: 556450 - DNA, 454 bp, Homo sapiens; identical to SEQ ID NO: 536846
  misc_feature: HIJSMM301AJDMR.18.78.H01.1.454.light.4.raw

SEQ ID NO: 556451 - DNA, 495 bp, Homo sapiens
  misc_feature: HIJSMM301DWRWE.16.68.G02.1.454.light.4.raw
  modified_base (427)..(427): a, c, t, g, unknown or other
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattnttaattcggtggagggaccaaggtggaggtacaaacgaactgtggctgcaccatctgtcttcattccc

SEQ ID NO: 556452 - DNA, 511 bp, Homo sapiens
  misc_feature: HIJSMM301EMWV4.40.67.G01.1.454.light.4.raw
tctagcgactcacgaccggtgctcgatttagagtatacatattgggtttgggggaaaaggccctgaggaaaacaaaccccagctgggaagcctgagaacacttagccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagaccccaggccagcctccacgttcactcatcgtcagcacaagcagacgtttgcctggggtgcctgatcgcttctctgcctccatccttgggaacaaagctgccctcaccattacgggggcccagccagaggatgagtcttattattactgcatgctccatgtggggggtgccacttgggtgttcggcggagggaccaagctgaccgtccg

SEQ ID NO: 556453 - DNA, 510 bp, Homo sapiens; identical to SEQ ID NO: 542037
  misc_feature: HIJSMM301B7Z9J.4.57.F02.1.454.light.4.raw

SEQ ID NO: 556454 - DNA, 444 bp, Homo sapiens; identical to SEQ ID NO: 534993
  misc_feature: HIJSMM301EUIRU.5.9.A09.1.454.light.4.raw

SEQ ID NO: 556455 - DNA, 483 bp, Homo sapiens; identical to SEQ ID NO: 535480
  misc_feature: HIJSMM301CYAQ8.46.26.C04.1.454.light.4.raw

SEQ ID NO: 556456 - DNA, 493 bp, Homo sapiens
  misc_feature: HIJSMM301A4G3E.49.41.D08.1.454.light.4.raw
agtcgagagacacgaccggtgctcgatttagtcacgcgagaaagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctgaagattctgcagtttattactgtcagcagcgtagcaactggcctctcactttcggcggagggaccaaggtggagatcaaacgaactgtggctgcaccatctgtctt

SEQ ID NO: 556457 - DNA, 464 bp, Homo sapiens; identical to SEQ ID NO: 536640
  misc_feature: HIJSMM301EI0ZY.26.78.H01.1.454.light.4.raw

SEQ ID NO: 556458 - DNA, 481 bp, Homo sapiens
  misc_feature: HIJSMM301CA8PV.7.81.H04.1.454.light.4.raw
  modified_base (452)..(452): a, c, t, g, unknown or other
cgtgtctctacacgaccggtgctcgatttagtagtgtagattcgcggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaaatcacttcgtcctcggacgtgtagagnatatagaagaagaactagtagcgtcgtca

SEQ ID NO: 556459 - DNA, 508 bp, Homo sapiens; identical to SEQ ID NO: 543043
  misc_feature: HIJSMM301CF2AL.15.59.F04.1.454.light.4.raw

SEQ ID NO: 556460 - DNA, 476 bp, Homo sapiens; identical to SEQ ID NO: 546088
  misc_feature: HIJSMM301ECYXX.13.71.G05.1.454.light.4.raw

SEQ ID NO: 556461 - DNA, 509 bp, Homo sapiens
  misc_feature: HIJSMM301AN7OB.13.73.G07.1.454.light.4.raw
tcacgtactacacgaccggtgctcgatttagctctacgctcaggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaacacccaggcaaagcccccaaactcattatttacggggtcaataagcggccctcagggctttctgatcgcttctctggctccaagtctggcaacacggcctccctgacaatctctggactccaggccgaggacgaggctgtatttttactgttgttcatatgcaggaaggagtgattatgtctttggaagtgggaccaggtcaccgtccttggtcagcccaaggccaaccccatgtcactctgttcccg

SEQ ID NO: 556462 - DNA, 471 bp, Homo sapiens; identical to SEQ ID NO: 536384
  misc_feature: HIJSMM301DQYMA.18.76.G10.1.454.light.4.raw

SEQ ID NO: 556463 - DNA, 499 bp, Homo sapiens
  misc_feature: HIJSMM301BZO6H.47.78.H01.1.454.light.4.raw
  modified_base (460)..(460): a, c, t, g, unknown or other
  modified_base (472)..(472): a, c, t, g, unknown or other
agctcacgtacacgaccggtgctcgatttagtgtgagtagtttgggtttgggaacctatgaacattctgtaggggccactgtcttctccacggtgctcccttcatgcgtgactcagccaccctcagcgtctgggacccccgggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcagcctccctggccatcagtgggctccggtccgaggatgaggctgattattattgtgcaacatggggatagtagcctgagtagtgtggttttcggtcggagggaccgaaactagaccgtcctaggtcagcccaaggctgccccctccggtnaccccccccctntcgttcccgccctcctctacgtgagct

SEQ ID NO: 556464 - DNA, 501 bp, Homo sapiens
  misc_feature: HIJSMM301DEDS5.22.27.C05.1.454.light.4.raw
acatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttattactgtcagcaaatattatattcctcctcagacgttcggccaagggaccaaggtggaaatcaaaacgaactgtggctgcacca

SEQ ID NO: 556465 - DNA, 491 bp, Homo sapiens
  misc_feature: HIJSMM301DQX8D.22.9.A09.1.454.light.4.raw
  modified_base (477)..(477): a, c, t, g, unknown or other
acatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcagtgggtctggaagagacttcactctcaccatcaacagcctagagcctgacgattctgcagttttattactgtcagcagcgtaccaagtggcctcactttgtcagggcgaagctggagatcagacgaaactgtggctgcaccactntctcttctactctt

SEQ ID NO: 556466 - DNA, 488 bp, Homo sapiens
  misc_feature: HIJSMM301AWRSA.49.81.H04.1.454.light.4.raw
agtcgagagacacgaccggtgctcgatttagtagtgtagattcgcggggggagtcagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatctaccactcactttcggcggagggaccacggtggaggatcaaacgaactagtggctgcaccatctgtt

SEQ ID NO: 556467 - DNA, 302 bp, Homo sapiens
  misc_feature: HIJSMM301DC4HW.12.25.C03.1.454.light.4.raw
atacgacgtacacgaccggtgctcgatttagtagtgtagatttgggtttgggaacctatgaacattctgtaggggccactgtcttctccacggtgctcccttcatgcgtgacctggcagctgtagcttccttgaccatcactggggctcaggcggaagatgaggctgactattactgcaactcccgggacagcagtggtaaacatttcaatgtgttattcggcggagggaccaagctgaccgtcctcggtcagcccaaggctgccccctcggtcactctgttcccgccctcctctacgtcgt

SEQ ID NO: 556468 - DNA, 505 bp, Homo sapiens; identical to SEQ ID NO: 535503
  misc_feature: HIJSMM301AX0VU.8.28.C06.1.454.light.4.raw

SEQ ID NO: 556469 - DNA, 516 bp, Homo sapiens
  misc_feature: HIJSMM301DM4UA.13.38.D05.1.454.light.4.raw
tcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcgtccaaggaccgaacggtaggaaagtactaaggacgaaccgtagtggcgtgcaccactactgtcttctatcttcccgt

SEQ ID NO: 556470 - DNA, 502 bp, Homo sapiens; identical to SEQ ID NO: 536253
  misc_feature: HIJSMM301BS6RK.21.22.B11.1.454.light.4.raw

SEQ ID NO: 556471 - DNA, 502 bp, Homo sapiens
  misc_feature: HIJSMM301BG3AZ.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggcccaacccatgtca

SEQ ID NO: 556472 - DNA, 509 bp, Homo sapiens
  misc_feature: HIJSMM301EOKFA.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccgacctttcggccctcgggaccgaaagtaggatatcaaacgaactagtggctgcaccatctgt

SEQ ID NO: 556473 - DNA, 505 bp, Homo sapiens; identical to SEQ ID NO: 535503
  misc_feature: HIJSMM301BCLYG.8.28.C06.1.454.light.4.raw

SEQ ID NO: 556474 - DNA, 521 bp, Homo sapiens; identical to SEQ ID NO: 538715
  misc_feature: HIJSMM301BMJTL.27.23.C01.1.454.light.4.raw

SEQ ID NO: 556475 - DNA, 495 bp, Homo sapiens
  misc_feature: HIJSMM301E2N3E.48.1.A01.1.454.light.4.raw
agtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaattttcgctgtctccagtttgcagagtggagtcccatctcggttcagcggcagtggatctggggcagagttcattctcaccatcaacagccttcagcctgaagattttgcaacttactattgtcagcagggtgacagtttccctcccactttcggtcggagggaccagggtggacgtcaaacgaactgtggctgcaccatctgtcttcatcttcccg

SEQ ID NO: 556476 - DNA, 487 bp, Homo sapiens; identical to SEQ ID NO: 541755
  misc_feature: HIJSMM301BG3A6.4.64.F09.1.454.light.4.raw

SEQ ID NO: 556477 - DNA, 473 bp, Homo sapiens
  misc_feature: HIJSMM301A5RJC.41.8.A08.1.454.light.4.raw
  modified_base (471)..(471): a, c, t, g, unknown or other
tctatactatcacgaccggtgctcgatttagcatactctacagggggcaggagtcagacccagtcaggacacagcatggacatgagggtccccgctcagctcctggggctcctgctgctctggttcccaggttccagatgcgacatccagatgacccagtctccatcttccctgtctgcatctgtaggagacagagtcaccatcacttgtcgggcgagtcaggatattagcagctttttagcctggtatcagcagagaccagggaaagcccctaaactcctgatctatgctgcatccagtttgcaaagtggggtcccatcaaggttcagcggcagtggatctgggacagatttcactctcaccatcagcagcctgcagccctgacgattttgcaacttactattgtcaacaggctaacagtttcccgatgaccgtcggccaagggacacgactggacattaaacgaactgngg

SEQ ID NO: 556478 - DNA, 484 bp, Homo sapiens
  misc_feature: HIJSMM301DJV2R.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatctccccactttcggccctgggaccaagtggatatcaaacgaactgtggctgcaccatctgt

SEQ ID NO: 556479 - DNA, 494 bp, Homo sapiens; identical to SEQ ID NO: 534994
  misc_feature: HIJSMM301AJQOH.27.78.H01.1.454.light.4.raw

SEQ ID NO: 556480 - DNA, 493 bp, Homo sapiens; identical to SEQ ID NO: 549048
  misc_feature: HIJSMM301EZ2TS.16.86.H09.1.454.light.4.raw

SEQ ID NO: 556481 - DNA, 485 bp, Homo sapiens; identical to SEQ ID NO: 541040
  misc_feature: HIJSMM301DUSD2.15.1.A01.1.454.light.4.raw

SEQ ID NO: 556482 - DNA, 354 bp, Homo sapiens; identical to SEQ ID NO: 535026
  misc_feature: HIJSMM301BXQ8Q.19.22.B11.1.454.light.4.raw

SEQ ID NO: 556483 - DNA, 474 bp, Homo sapiens
  misc_feature: HIJSMM301BHY98.7.83.H06.1.454.light.4.raw
cgtgtctctacacgaccggtgctcgatttagatcacgtgcgtcgcggggctccaaacagagcttcagcaagcatagtgggaatctgcaccatgcccggggctctgctcctcctgaccctcctcactcactctgcagtgtcagtggtccaggcagggctgactcagccgccctcggtgtccaagggcttggggcagaccgccacactcacctgcactgggaacagcaacaatgttggcgaccaaggagcagcttggctgcagcagcaccagggccaccctcccaaactcctatcctacaggaataacaaccggccctcagggatctcggagagattctctgcatccaggtcaggatacacagcctccctgaccattactggactccagcctgaggacgaggctgactattactgctcagcatgggacagcagcctccgtggtgtggtgatcggcggagggccaggctgaccgtct

SEQ ID NO: 556484 - DNA, 484 bp, Homo sapiens; identical to SEQ ID NO: 535441
  misc_feature: HIJSMM301AIXS2.26.60.F05.1.454.light.4.raw

SEQ ID NO: 556485 - DNA, 478 bp, Homo sapiens; identical to SEQ ID NO: 541670
  misc_feature: HIJSMM301C3JRD.13.73.G07.1.454.light.4.raw

SEQ ID NO: 556486 - DNA, 495 bp, Homo sapiens
  misc_feature: HIJSMM301B7WPI.22.14.B03.1.454.light.4.raw
  modified_base (483)..(483): a, c, t, g, unknown or other
acatacgcgtcacgaccggtgctcgatttagtgtgagtagttccgcggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttatattgtcagcaatattatattcctcctcagacgttcggccaagggaccaagtggaaatcaaacgaactntggctgcaccaa

SEQ ID NO: 556487 - DNA, 489 bp, Homo sapiens; identical to SEQ ID NO: 535139
  misc_feature: HIJSMM301DY2MK.14.55.E11.1.454.light.4.raw

SEQ ID NO: 556488 - DNA, 464 bp, Homo sapiens; identical to SEQ ID NO: 537111
  misc_feature: HIJSMM301BN9F9.17.28.C06.1.454.light.4.raw

SEQ ID NO: 556489 - DNA, 467 bp, Homo sapiens
  misc_feature: HIJSMM301CY73V.5.15.B04.1.454.light.4.raw
atcagacacgcacgaccggtgctcgatttagacagtatatatccgcgggggcaggagtcagactcagtcaggacacagcatggacatgagggtccccgctcagctcctggggctcctgctgctctggctcccaggtgccaaatgtgacatccagatgacccagtctccttccaccctgtctgcatctataggagacagagtcaccatcacttgccgggccagtcagagtattagtaactggttggcctggtatcagcagaaaccaggcaaagccccaaagctccttatctctgatgcctccactttgcacggtgggtcccaccaacgttcagcggcagtggatctgggacagaattcactctcaccatcagcagcctgcagcctgatgatgctgcaacttattactgtcaacaatataacagttaattggacgttcggccaagggaccaaggtggaaatcaaacgaa

SEQ ID NO: 556490 - DNA, 487 bp, Homo sapiens; identical to SEQ ID NO: 535583
  misc_feature: HIJSMM301D50ZB.22.73.G07.1.454.light.4.raw

SEQ ID NO: 556491 - DNA, 494 bp, Homo sapiens; identical to SEQ ID NO: 534994
  misc_feature: HIJSMM301AHAJG.27.78.H01.1.454.light.4.raw

SEQ ID NO: 556492 - DNA, 493 bp, Homo sapiens; identical to SEQ ID NO: 540127
  misc_feature: HIJSMM301DRNV9.10.17.B06.1.454.light.4.raw

SEQ ID NO: 556493 - DNA, 487 bp, Homo sapiens
  misc_feature: HIJSMM301CNGWQ.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtaccccctcactttcggcgagggaccaaggcggagatcagacgaactgtggctgcaccatctgtcttcta

SEQ ID NO: 556494 - DNA, 518 bp, Homo sapiens; identical to SEQ ID NO: 539372
  misc_feature: HIJSMM301BQT8B.7.86.H09.1.454.light.4.raw

SEQ ID NO: 556495 - DNA, 508 bp, Homo sapiens
  misc_feature: HIJSMM301D9SK4.19.78.H01.1.454.light.4.raw
tactctcgtgcacgaccggtgctcgatttagtgtgagtagtttgggtttgggggggtcgacaagaggcagcgctctcgggacgtctccaccatggcctgggctctgctgctcctcactctcctcactcaggacacagggtccgtgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaacggccaaccccactgtca

SEQ ID NO: 556496 - DNA, 491 bp, Homo sapiens
  misc_feature: HIJSMM301DQZ64.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctcgctcactttcggcggagggaccagggtggagatcaaacgaactgtggctgcaccatctgtcttcat

SEQ ID NO: 556497 - DNA, 487 bp, Homo sapiens; identical to SEQ ID NO: 536179
  misc_feature: HIJSMM301D16B4.19.57.F02.1.454.light.4.raw

SEQ ID NO: 556498 - DNA, 468 bp, Homo sapiens
  misc_feature: HIJSMM301AVJN8.49.27.C05.1.454.light.4.raw
agtcgagagacacgaccggtgctcgatttagacgcgatcgaagggtttgggggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctcccgctcactttcggcggggggccgaaggtggagatcaagcgaa

SEQ ID NO: 556499 - DNA, 492 bp, Homo sapiens; identical to SEQ ID NO: 536010
  misc_feature: HIJSMM301DYEAI.10.20.B09.1.454.light.4.raw

SEQ ID NO: 556500 - DNA, 444 bp, Homo sapiens; identical to SEQ ID NO: 535027
  misc_feature: HIJSMM301A0TV7.8.73.G07.1.454.light.4.raw

SEQ ID NO: 556501 - DNA, 484 bp, Homo sapiens
  misc_feature: HIJSMM301C1JQO.52.38.D05.1.454.light.4.raw
cgcagtacgacacgaccggtgctcgatttagtatctgatagttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatggtgcatcaactttgcaaggtgggtcccatcaaggttcagcggcagtggatctgggacagaattcactctcacaatcagcagcctgcagcctgaagattttgcaacttattactgtcaacaccttaatattactccttcactttcggccctgggaccaaagtggacatccaaagaactgtggctgcaccatctgtctt

SEQ ID NO: 556502 - DNA, 491 bp, Homo sapiens; identical to SEQ ID NO: 542310
  misc_feature: HIJSMM301CPLG0.22.65.F10.1.454.light.4.raw

SEQ ID NO: 556503 - DNA, 489 bp, Homo sapiens; identical to SEQ ID NO: 543840
  misc_feature: HIJSMM301CWN7H.12.88.H11.1.454.light.4.raw

SEQ ID NO: 556504 - DNA, 489 bp, Homo sapiens; identical to SEQ ID NO: 540381
  misc_feature: HIJSMM301D1IV7.51.6.A06.1.454.light.4.raw

SEQ ID NO: 556505 - DNA, 487 bp, Homo sapiens; identical to SEQ ID NO: 538190
  misc_feature: HIJSMM301AOWFF.47.70.G04.1.454.light.4.raw

SEQ ID NO: 556506 - DNA, 492 bp, Homo sapiens; identical to SEQ ID NO: 535126
  misc_feature: HIJSMM301BV5VW.18.11.A11.1.454.light.4.raw

SEQ ID NO: 556507 - DNA, 434 bp, Homo sapiens; identical to SEQ ID NO: 535153
  misc_feature: HIJSMM301EM01D.18.5.A05.1.454.light.4.raw

SEQ ID NO: 556508 - DNA, 444 bp, Homo sapiens; identical to SEQ ID NO: 535042
  misc_feature: HIJSMM301CVQAG.10.76.G10.1.454.light.4.raw

SEQ ID NO: 556509 - DNA, 483 bp, Homo sapiens
  misc_feature: HIJSMM301DV8KL.48.38.D05.1.454.light.4.raw
agtatacatacacgaccggtgctcgatttagtatctgatagttgggtttgggggtggtagctcaggaagcagagcctggagcatctccactatggcctgggctccactacttctcaccctcctcgctcactgcacaggttcttgggcccattttatgctgactcagccccactctgtgtcggagtctccggggaagacggtgaccatctcctgcacccgcagcagtggcagcgttgccaccaactatgtgcagtggttccagcagcgcccgggcagttcgcccatcactgtgatctatgagaataatgagagaccctctggggtccccgatcggttctctggctccatcgacaggtcctccaactctgcctctctcaccatctctggactgcagactgaggacgaggctgattactactgtcagtcttatgatagtggcaataatgtttgggtgtttggcggagggaccaagctgaccgtcct

SEQ ID NO: 556510 - DNA, 493 bp, Homo sapiens; identical to SEQ ID NO: 536769
  misc_feature: HIJSMM301CVWOS.19.83.H06.1.454.light.4.raw

SEQ ID NO: 556511 - DNA, 501 bp, Homo sapiens
  misc_feature: HIJSMM301CY2UB.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgatttattactgcagctcatatacaagcaccagcactctctatgtcttcggaactgggaccaggtcaccgtctaggtcagcccaaggccaaccca

SEQ ID NO: 556512 - DNA, 488 bp, Homo sapiens; identical to SEQ ID NO: 535990
  misc_feature: HIJSMM301CPML7.11.28.C06.1.454.light.4.raw

SEQ ID NO: 556513 - DNA, 490 bp, Homo sapiens; identical to SEQ ID NO: 549445
  misc_feature: HIJSMM301CDCFR.52.85.H08.1.454.light.4.raw

SEQ ID NO: 556514 - DNA, 463 bp, Homo sapiens; identical to SEQ ID NO: 535062
  misc_feature: HIJSMM301A5D76.11.73.G07.1.454.light.4.raw

SEQ ID NO: 556515 - DNA, 501 bp, Homo sapiens
  misc_feature: HIJSMM301ALA6Z.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggaggaccaaactgaccgtcctaggtcagcccaa

SEQ ID NO: 556516 - DNA, 480 bp, Homo sapiens; identical to SEQ ID NO: 535630
  misc_feature: HIJSMM301BTR8Z.40.59.F04.1.454.light.4.raw

SEQ ID NO: 556517 - DNA, 421 bp, Homo sapiens
  misc_feature: HIJSMM301CXGLD.41.15.B04.1.454.light.4.raw
tctatactatcacgaccggtgctcgatttagacagtatatatccgcgggcacgaccggtgctcgatttagtctagcgatttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 556518 - DNA, 486 bp, Homo sapiens; identical to SEQ ID NO: 535043
  misc_feature: HIJSMM301DFIN8.46.35.D02.1.454.light.4.raw

SEQ ID NO: 556519 - DNA, 505 bp, Homo sapiens
  misc_feature: HIJSMM301BP410.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaaactgaccgtcctaggtccagccccaa

SEQ ID NO: 556520 - DNA, 441 bp, Homo sapiens; identical to SEQ ID NO: 534971
  misc_feature: HIJSMM301AZ06O.11.3.A03.1.454.light.4.raw

SEQ ID NO: 556521 - DNA, 485 bp, Homo sapiens; identical to SEQ ID NO: 536075
  misc_feature: HIJSMM301D18TP.17.21.B10.1.454.light.4.raw

SEQ ID NO: 556522 - DNA, 443 bp, Homo sapiens
  misc_feature: HIJSMM301DH24P.9.71.G05.1.454.light.4.raw
tgatacgtctcacgaccggtgctcgatttagtgtcgtcgcaagagagaggggccctgtctgccctgactcagcctgcctccgtgtctgggtctcctggacagtcgatcaccatctcctgcactggacccaccactgatatcgggcattataaccttgtctcctggtatcaacaacgcccagacaaagccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcggagggaccaggctgaccgtcctgagtcagcccaaggctgccccctcggtcactctgttcccaccctcctcagacgtatca

SEQ ID NO: 556523 - DNA, 486 bp, Homo sapiens; identical to SEQ ID NO: 545000
  misc_feature: HIJSMM301BPNVB.49.53.E09.1.454.light.4.raw

SEQ ID NO: 556524 - DNA, 513 bp, Homo sapiens; identical to SEQ ID NO: 535719
  misc_feature: HIJSMM301CZI0X.17.33.C11.1.454.light.4.raw

SEQ ID NO: 556525 - DNA, 491 bp, Homo sapiens
  misc_feature: HIJSMM301DN4CZ.16.12.B01.1.454.light.4.raw
tgtactactccacgaccggtgctcgatttagtagtgtagattccgcggggctgggcctcaggaagcagcatcggaggtgcctcagccatggcatggatccctctcttcctcggcgtccttgcttactgcacagtatcggtggcctcctatcagttgactcagccaccctcagtgtccgtgtccccaggacagacggccagcatcatctgctctggagataacttgggggataaatatactttctggtatcagcagaaggccggccagtcccctgtattggtcatctttcaagataccgagcggccctcagagatccctgagcgattctctggctccaactctgggaacacagccactctgaccatcagcggggcccagactatggatgaggctgactattactgtcaggcgtgggacagcaattctgtgattttcggcggagggaccaagttgaccgtcctaggtcagccaaggctgccccctcggtcact

SEQ ID NO: 556526 - DNA, 480 bp, Homo sapiens
  misc_feature: HIJSMM301BLUND.11.76.G10.1.454.light.4.raw
cgagagataccacgaccggtgctcgatttagtcactcatacagggagctacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaacagaagccaggccagcctccaaagcagctcatttattgggcatctactcgggattccggggtccctgaccgattccgtggcagtggatctgggacaaatttcactctcaccatcaatagcctgcaggctgaagatgtggcagcttattattgtcagcaatattatacttctcttccgatcacttttggccaggggaccaggctggagatcagacgaa

SEQ ID NO: 556527 - DNA, 513 bp, Homo sapiens
  misc_feature: HIJSMM301DYILH.41.30.C08.1.454.light.4.raw
tctatactatcacgaccggtgctcgatttagtctgacgtcaaagggaaaggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgattaccatctcctgctctgggatcaacagcgaccttggtggttataactatgtgtcctggtaccaacaatatccaggcaaacccccaaagtcatcatttatgatgtcggtagtcggccctccggggtctctagtcgcttctctggctccaagtctggcaacacggcctccctgaccatctctgggctccaggctgaggacgaggctgactattactgcagttcatatacaagcagcagcactggagtcttcggaactgggaccagggtcaccgtcctaggtcagcccaaggccaaccccactgtcactcttcg

SEQ ID NO: 556528 - DNA, 489 bp, Homo sapiens; identical to SEQ ID NO: 535139
  misc_feature: HIJSMM301C4ZT2.14.55.E11.1.454.light.4.raw

SEQ ID NO: 556529 - DNA, 486 bp, Homo sapiens; identical to SEQ ID NO: 537127
  misc_feature: HIJSMM301AEVX7.3.77.G11.1.454.light.4.raw

SEQ ID NO: 556530 - DNA, 508 bp, Homo sapiens; identical to SEQ ID NO: 540739
  misc_feature: HIJSMM301BCN1W.14.7.A07.1.454.light.4.raw

SEQ ID NO: 556531 - DNA, 507 bp, Homo sapiens
  misc_feature: HIJSMM301DR2B3.15.5.A05.1.454.light.4.raw
tctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccgccctcctcgctacgtaga

SEQ ID NO: 556532 - DNA, 487 bp, Homo sapiens; identical to SEQ ID NO: 538190
  misc_feature: HIJSMM301EVVPR.47.70.G04.1.454.light.4.raw

SEQ ID NO: 556533 - DNA, 509 bp, Homo sapiens
  misc_feature: HIJSMM301CCGOJ.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggccccaaaattggtcatctatgaagacgacaaacgaccctccggggatccctgagagattctctggctccagctcagggactatggccaccttgactatcagtgggcccaagtggaggatgaagctgactactactgttactcaatagagaacaagtgataatttctgggtgttcggcggagggaccaaactgaccgtcctaggtcagcccaaggctgcccctcggtcactctgttccccg

SEQ ID NO: 556534 - DNA, 495 bp, Homo sapiens; identical to SEQ ID NO: 543876
  misc_feature: HIJSMM301DE3YW.2.49.E05.1.454.light.4.raw

SEQ ID NO: 556535 - DNA, 506 bp, Homo sapiens
  misc_feature: HIJSMM301CINNB.12.53.E09.1.454.light.4.raw
atacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcacttttcgatgtcctattcggcggagggaccaagctgaccgtcctgggtcagcccaaggctgccccctcggtcattctgttcccgccctcctctacgtcgtat

SEQ ID NO: 556536 - DNA, 504 bp, Homo sapiens
  misc_feature: HIJSMM301AV3S6.5.59.F04.1.454.light.4.raw
atcagacacgcacgaccggtgctcgatttagtacacacacttagggattggggctgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctgggacagacttcactctcaccatcagcagactggagcctgaagattttgcagtgtattactgtcagcagtatggtagctcacggacgttcggccaagggaccgaaggtggaaagtcaaacgaactagtggctgcaccatctgtcttcatcttcccgccta

SEQ ID NO: 556537 - DNA, 494 bp, Homo sapiens; identical to SEQ ID NO: 543247
  misc_feature: HIJSMM301CUBK5.22.57.F02.1.454.light.4.raw

SEQ ID NO: 556538 - DNA, 477 bp, Homo sapiens
  misc_feature: HIJSMM301BBXIP.52.53.E09.1.454.light.4.raw
  modified_base (409)..(409): a, c, t, g, unknown or other
cgcagtacgacacgaccggtgctcgatttagagagagtgtgttgggtttggggcagcctcagcagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacgtatccctgatcgcttctcaggctccggctctgggactgagcgctacctcaccatctccagcctccagtctgaggacgagggtnactattactgtcagacgtgggacactggcatttgggtgttcggcggagggaccaagttgaccgtccta

SEQ ID NO: 556539 - DNA, 512 bp, Homo sapiens
  misc_feature: HIJSMM301EU4OW.5.58.F03.1.454.light.4.raw
atcagacacgcacgaccggtgctcgatttagtctgatcgagaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcacacttttatgttcgggactgggaccaaggtcaccgtcctaggtcagcccaaggccaaccccactgtcactctcg

SEQ ID NO: 556540 - DNA, 488 bp, Homo sapiens
  misc_feature: HIJSMM301DXUP6.17.25.C03.1.454.light.4.raw
cgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacagatttcaatctcaccatcaccactctgcaacctgaggattgtgcaatctactactgtcaacagagttacacgttcccctcgcacttttggccagggaccaaagttgagatacaaacgaactgtggctgcaccatctgtt

SEQ ID NO: 556541 - DNA, 494 bp, Homo sapiens; identical to SEQ ID NO: 539922
  misc_feature: HIJSMM301C1OAM.27.78.H01.1.454.light.4.raw

SEQ ID NO: 556542 - DNA, 503 bp, Homo sapiens
  misc_feature: HIJSMM301BEJ5G.22.15.B04.1.454.light.4.raw
acatacgcgtcacgaccggtgctcgatttagacagtatatatccgcgggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacaacacccaggcaaagcccccaaactcatgatttatgaggtcactaagcggccctcaggggtccctgatcgcttctctggctccaagtctggcaacacggcctccctgaccgtctctgggctccaggctgaggatgaggctgattattactgcagctcatatggaggcagcgacaatttggtgttcggcggaggggaccaagctgaccgtcctaggtcagcccaaggctgccccctcggtca

SEQ ID NO: 556543 - DNA, 445 bp, Homo sapiens; identical to SEQ ID NO: 545287
  misc_feature: HIJSMM301B6ZKI.2.76.G10.1.454.light.4.raw

SEQ ID NO: 556544 - DNA, 504 bp, Homo sapiens; identical to SEQ ID NO: 539083
  misc_feature: HIJSMM301BMLLO.8.19.B08.1.454.light.4.raw

SEQ ID NO: 556545 - DNA, 451 bp, Homo sapiens
  misc_feature: HIJSMM301D04U6.40.14.B03.1.454.light.4.raw
tctagcgactcacgaccggtgctcgatttagtgtgagtagttccgcggggcagcttcagctgtgggtagagaagacaggactcaggacaatctccagcatggccagcttccctctcctcctcaccctcctcactcactgtgcagggtcctgggcccagtctgtcctgactcagccaccctcagcgtctcggggacccccgggcgagggggtcatgatctcttgttttggaagtagctccaacatcggaagtaataatgtgaactggtctggcacctcagcctccctggccatcattgatctccagtctgaggatgaggctgactattactgttcagcatgggatgccagcctgaatgtctgggtgttcggcggagggaccaagttgaccgtcctaggtcagccaaggctgccccctcggtcactctgttcccgccctcctcagtcgctaga

SEQ ID NO: 556546 - DNA, 497 bp, Homo sapiens; identical to SEQ ID NO: 538296
  misc_feature: HIJSMM301BLAMO.18.11.A11.1.454.light.4.raw

SEQ ID NO: 556547 - DNA, 494 bp, Homo sapiens; identical to SEQ ID NO: 537418
  misc_feature: HIJSMM301EQW99.9.1.A01.1.454.light.4.raw

SEQ ID NO: 556548 - DNA, 447 bp, Homo sapiens; identical to SEQ ID NO: 535882
  misc_feature: HIJSMM301ASW85.18.9.A09.1.454.light.4.raw
  modified_base (429)..(429): a, c, t, g, unknown or other

SEQ ID NO: 556549 - DNA, 511 bp, Homo sapiens
  misc_feature: HIJSMM301A45EB.17.27.C05.1.454.light.4.raw
cgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtcatttatggtaagaataaccggccctcagggatcccagaccgattctctggctccgactcaggaaagacagcttccctgaccatcactggggctcaggcggaagatgaggctgactattactgtaactcccgggacagcagtgctgaccaggtggtattcggcgggacgggacccaccgtcgaccgtcttaggtcacgcccaaggcctcggccccctcggtccta

SEQ ID NO: 556550 - DNA, 493 bp, Homo sapiens; identical to SEQ ID NO: 535047
  misc_feature: HIJSMM301EN2MB.16.53.E09.1.454.light.4.raw

SEQ ID NO: 556551 - DNA, 508 bp, Homo sapiens
  misc_feature: HIJSMM301BVJLD.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgccccctcggtcactctgt

SEQ ID NO: 556552 - DNA, 489 bp, Homo sapiens; identical to SEQ ID NO: 543809
  misc_feature: HIJSMM301BR4BA.19.71.G05.1.454.light.4.raw

SEQ ID NO: 556553 - DNA, 529 bp, Homo sapiens
  misc_feature: HIJSMM301C3B23.15.34.D01.1.454.light.4.raw
tctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtggggcggtggcatttgggttggttcggtcgggacggggaccgaaacctagaccgtccctaggtcagcccaacggactgccccctccggtcactcttcg

SEQ ID NO: 556554 - DNA, 502 bp, Homo sapiens; identical to SEQ ID NO: 536584
  misc_feature: HIJSMM301CG21F.14.57.F02.1.454.light.4.raw

SEQ ID NO: 556555 - DNA, 501 bp, Homo sapiens
  misc_feature: HIJSMM301EAD7F.15.1.A01.1.454.light.4.raw
  modified_base (472)..(472): a, c, t, g, unknown or other
tctacgtagccacgaccggtgctcgatttagacgtctcatcaggggggggtcgacaagaggcagcgctctcgggacgtctccaccatggcctgggctctgctgctcctcactctcctcactcaggacacagggtcctgggcccagtctgccctcgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctggctccaggctgacgacgaggctaattattactgctgctcatatgaaggttataacactatactattcggcggagggaccaagctgaccgtcctncggtcagcccagctgccccctcggtcact

SEQ ID NO: 556556 - DNA, 487 bp, Homo sapiens
  misc_feature: HIJSMM301BHT4W.13.5.A05.1.454.light.4.raw
tcacgtactacacgaccggtgctcgatttagatagatagacaggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagaaatggatatacctatttggattggtatctgcagaagccagggcagtctccacaactcctgatctattggggttctaatcgggcctccggggtccctgacaggttcagtggcagtggatcaggcacagattttacactgaaaatcagcagagtggaggctgaggatgttggggtttattactgcatgcaagctctacaaactctgcggactttcggccctggaccgaaagtggagagtcaaacgaactagtgg

SEQ ID NO: 556557 - DNA, 480 bp, Homo sapiens
  misc_feature: HIJSMM301EEPOR.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtggggtcccatcaaggttcagcggcagtgggtctgggacagaattcactctcaccatcagcagcctgcaacctgatgactttgcaacttattactgccaacagtataatggttatgaatccacttttgccaaggccaagctgagatcaaagaactgtggctgc

SEQ ID NO: 556558 - DNA, 473 bp, Homo sapiens
  misc_feature: HIJSMM301DXP1E.49.32.C10.1.454.light.4.raw
agtcgagagacacgaccggtgctcgatttagtatagacatcaacacacaaaggggcagtcccaaccaggacacagcatggacatgagggtccctgctcagctcctggggctcctgctgctctggctctcaggtgccagatgtatcatccagatgacccagtctccatcctccgtgtctgcatttataggagacagaatcaccatcacttgccgggcgagtcaggacattagcatgtatctgaattggtatcagcaaaaaccagggaaagcccctaagctcctgatcctcgatgcatccaatttggaaacaggggtcccatcaaggttcagtgcaagtggctctgggacagatttcaactttcaccatcagcagactgcagcctgaagatattgcaacatattactgtcaacagtatgataatcttccgctcactttcggcggagggaccaaggtggggagtcagacgaactgt

SEQ ID NO: 556559 - DNA, 486 bp, Homo sapiens; identical to SEQ ID NO: 535043
  misc_feature: HIJSMM301EAZA9.46.35.D02.1.454.light.4.raw

SEQ ID NO: 556560 - DNA, 502 bp, Homo sapiens
  misc_feature: HIJSMM301BW70N.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgctttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctggtcactc

SEQ ID NO: 556561 - DNA, 493 bp, Homo sapiens; identical to SEQ ID NO: 535084
  misc_feature: HIJSMM301CQOCU.47.64.F09.1.454.light.4.raw

SEQ ID NO: 556562 - DNA, 474 bp, Homo sapiens; identical to SEQ ID NO: 537034
  misc_feature: HIJSMM301BLH88.5.15.B04.1.454.light.4.raw

SEQ ID NO: 556563 - DNA, 490 bp, Homo sapiens; identical to SEQ ID NO: 535526
  misc_feature: HIJSMM301BVKHO.26.78.H01.1.454.light.4.raw

SEQ ID NO: 556564 - DNA, 514 bp, Homo sapiens
  misc_feature: HIJSMM301A24SQ.48.14.B03.1.454.light.4.raw
agtatacatacacgaccggtgctcgatttagtgtgagtagttccgcggggatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaagtaaaaatggaaacatttacttacattggtttcaacagaggccaggccagtctccaaggcgcctgatttatgacgtttttaaacgggagtctggggtcccagacagattcagcggcagtgggtcagacactgacttcacactgagaatcagcagggttgaggctgaggatgttggcacttattactgcatgcaaggctcacactggcctccgtggacgttcggccaagggacccgggtggaaataaacgaactgtggctgcaccatctgtcttcatcttccccg

SEQ ID NO: 556565 - DNA, 489 bp, Homo sapiens; identical to SEQ ID NO: 546040
  misc_feature: HIJSMM301E4ASC.11.12.B01.1.454.light.4.raw

SEQ ID NO: 556566 - DNA, 515 bp, Homo sapiens
  misc_feature: HIJSMM301AZTB5.41.9.A09.1.454.light.4.raw
tctatactatcacgaccggtgctcgatttagcgagacgcgcaggggagcttcagctgtgggtagagaagacaggactcaggacaatctccagcatggccagcttccctctcctcctcaccctcctcactcactgtgcagggtcctgggcccagtctgtcctgactcagccaccctcagcgtctgggacccccgggcagacggtgaccatctcctgttctggaagcagttccaacatcggaagtaataatgtgaattggtaccggcaactcccaggaacggcccccaaactcctcatacatagtaatgatcatcggccccctggggtccctgaccgaatctctggctccaggtctggcgcctcagcctccctggtcattagtgggctccagtctgacgatgaggctgactattactgttcagcgtgggatgccagcccgaatcattgggtgttcggcggagggaccaaactgaccgtcctaggtcagcccaaggctgccccctcggtcactcttcg

SEQ ID NO: 556567 - DNA, 511 bp, Homo sapiens
  misc_feature: HIJSMM301AV15S.48.17.B06.1.454.light.4.raw
agtatacatacacgaccggtgctcgatttagtcgatagtgaaggggctggggtcacaagaggcagcgctctcgggacgtctccaccatggcctgggctctgctgctcctcaccctcctcactcaggacacagggtcctgggcccaggctgccctgactcagccagcctccgtgtctgcctctcctggacagtcggtcaatctttcctgcactggaaccgcctatgacattggaaaatataaccttgtctcctggtaccagcaacacccaggcaaagcccccaaattaattatttatacggtcaataagagaccgtcaggggtctctgctcgcttctctgggtccaagtctggcgacacggcctccctcacaatctctgggctccaggctgacgacgaggcttcctattgctgctcctcatatgtaggatccggctcttatctgattttcggcggagggaccaagctgaccgtcctacgtcagcccaaggctgccccctcggtcactctgtt

SEQ ID NO: 556568 - DNA, 508 bp, Homo sapiens
  misc_feature: HIJSMM301C6HBH.48.15.B04.1.454.light.4.raw
agtatacatacacgaccggtgctcgatttagacagtatatatccgcgggggctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaaactactcatttactcggcatccacccggaagtccgaggttcctgaccgattccgtggcagcgggtctgggacagattttactctcaccatcactaccctgcaggctgaagatgtggcagtttattactgtcaacaatattattctactccgccgacgttcggccgggggaccaacgtggaaatcaaacgaactagtggctgcaccatctgtcttcatt

SEQ ID NO: 556569 - DNA, 502 bp, Homo sapiens; identical to SEQ ID NO: 537816
  misc_feature: HIJSMM301BTPW9.19.78.H01.1.454.light.4.raw

SEQ ID NO: 556570 - DNA, 491 bp, Homo sapiens; identical to SEQ ID NO: 537488
  misc_feature: HIJSMM301BPU4S.15.3.A03.1.454.light.4.raw

SEQ ID NO: 556571 - DNA, 447 bp, Homo sapiens; identical to SEQ ID NO: 535201
  misc_feature: HIJSMM301A2JOX.18.9.A09.1.454.light.4.raw

SEQ ID NO: 556572 - DNA, 500 bp, Homo sapiens
  misc_feature: HIJSMM301CD3AH.18.78.H01.1.454.light.4.raw
tacgagtatgcacgaccggtgctcgatttagtgtgagtagtttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtctaggtcagcccaaggccaaccca

SEQ ID NO: 556573 - DNA, 481 bp, Homo sapiens
  misc_feature: HIJSMM301DUW4G.48.10.A10.1.454.light.4.raw
agtatacatacacgaccggtgctcgatttagcgtcgatctcaggggagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttattctgccaacagtatcatacttattctcggacttcgcacggacacggtggaatcaacgaactacgtggcgtgcaccaactctcgtcttcatt

SEQ ID NO: 556574 - DNA, 447 bp, Homo sapiens; identical to SEQ ID NO: 554727
  misc_feature: HIJSMM301BL78A.18.9.A09.1.454.light.4.raw
  modified_base (429)..(429): a, c, t, g, unknown or other

SEQ ID NO: 556575 - DNA, 486 bp, Homo sapiens
  misc_feature: HIJSMM301ANL4I.47.62.F07.1.454.light.4.raw
  modified_base (413)..(413): a, c, t, g, unknown or other
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacngtaatcataatctccccactttcggccctgggaccaagtggatatcaaacgaactgtggctgcaccatctgtt

SEQ ID NO: 556576 - DNA, 503 bp, Homo sapiens
  misc_feature: HIJSMM301BGQ7X.12.53.E09.1.454.light.4.raw
atacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtctattcggcgagggaccaagctgaccgtcctgggtcagcccaaggctgccccctcggtcactctgttcccgccctcctctacgtcgtat

SEQ ID NO: 556577 - DNA, 501 bp, Homo sapiens; identical to SEQ ID NO: 536867
  misc_feature: HIJSMM301AR3XD.5.86.H09.1.454.light.4.raw

SEQ ID NO: 556578 - DNA, 486 bp, Homo sapiens; identical to SEQ ID NO: 535917
  misc_feature: HIJSMM301ECSKU.3.10.A10.1.454.light.4.raw

SEQ ID NO: 556579 - DNA, 487 bp, Homo sapiens
  misc_feature: HIJSMM301CFHPD.40.37.D04.1.454.light.4.raw
tctagcgactcacgaccggtgctcgatttagtagcatactgttgggtttgggggatcaggacttctcagttcatcttctcaccatgaggctccctgctcagctcctggggctgctaatgctctggatccctggttccagtgcgagggttgtgatgactcagactccactctctctgtccgtcacccctggacagccggcctccatctcctgcaagtctgctcagagcctcctgcatggtgatggaatcacctatttatattggtacctgcagaagccaggccagtctccacagctcctaatctatgaggtttccagccggttctctggagtgccagataggttcagtggcagcgggtcagtgacagatttcacactgaaaatcagccgggtggaggctgaggatgttggggtttattactgcatgcaaggtttataccttcctcggacttcggcccgtcgggaccgagagtggagtgtacaacgaac

SEQ ID NO: 556580 - DNA, 481 bp, Homo sapiens; identical to SEQ ID NO: 544259
  misc_feature: HIJSMM301DTZVA.3.38.D05.1.454.light.4.raw

SEQ ID NO: 556581 - DNA, 433 bp, Homo sapiens; identical to SEQ ID NO: 535093
  misc_feature: HIJSMM301A9MFE.18.5.A05.1.454.light.4.raw

SEQ ID NO: 556582 - DNA, 490 bp, Homo sapiens; identical to SEQ ID NO: 542820
  misc_feature: HIJSMM301CTVWU.11.12.B01.1.454.light.4.raw

SEQ ID NO: 556583 - DNA, 506 bp, Homo sapiens
  misc_feature: HIJSMM301EQGCW.13.36.D03.1.454.light.4.raw
tcacgtactacacgaccggtgctcgatttagctgcgtcacgatctctcttggggagcttcagctgtggtagagaagacaggattcaggacaatctccagcatggccggcttccctctcctcctcaccctcctcactcactgtgcagggtcctgggcccagtctgtgctgactcagccaccctcagcgtctgggacccccgggcagagtgtcaccatctcttgttctggaggcagtgccaacatcgggagtaattatgcattctggtatcaacaactcccaggaacggcccccagactcctcatctatagcaataaccagcggccctcaggggtccctgaccgattctctggctccaagtctggcacctcagcctccctggccatcagtgggctccggtccgacgatgaggctgattattactgttcagcttgggatgacagcctgaatacttgggttttcggcggagggaccgaagttgaccgccctaggtcagcccaaggctccg

SEQ ID NO: 556584 - DNA, 472 bp, Homo sapiens
  misc_feature: HIJSMM301DNFEG.5.28.C06.1.454.light.4.raw
atcagacacgcacgaccggtgctcgatttagagctcacgtattgggtttgggggcaggagtcagtcccaaccaggacacagcatggacatgagggtccctgctcagctcctggggctcctgctgctctggctctcaggtgccagatgtgacatccagatgacccagtctccatcgtccgtgtctgcatctgtaggagacagagtcaccatcacttgtcaggcgagtcaggacattggtaattacttaacttggtatcagcagaaaccagggaaacgtccccaaactcctgatctacgatgcatctaatttggaaataggggtctcatcaaggttcagtgggagtggatctgggacagaattcactttcaccatcagcagcctgcaacctgaagatattgcaacatattactgtcaacagtatgatagtctggccgccttcggcggagggaccgaaggtggagatcgaacgaa

SEQ ID NO: 556585 - DNA, 488 bp, Homo sapiens; identical to SEQ ID NO: 535861
  misc_feature: HIJSMM301CJ7G5.14.55.E11.1.454.light.4.raw

SEQ ID NO: 556586 - DNA, 478 bp, Homo sapiens; identical to SEQ ID NO: 535129
  misc_feature: HIJSMM301BCXD5.11.11.A11.1.454.light.4.raw

SEQ ID NO: 556587 - DNA, 513 bp, Homo sapiens
  misc_feature: HIJSMM301D4VFI.9.43.D10.1.454.light.4.raw
tgatacgtctcacgaccggtgctcgatttagactagcagtaagggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcattggtggttatgactatgtctcctggtatcaacaacacccaggcaaagcccccaaactcttgatttatgaggtcagtaggaggccctcaggggtccctgatcgcttctctggctccaagtctgccaacacggcctccctgaccgtctctgggctccaggctgaggatgaggctgattattattgcagctcatattcaggcagtaacagggttttcggcggagggaccaagctgaccgtcctaggtcagccaaggctgccccctccggtcactctcgttcccaccctcctcacg

SEQ ID NO: 556588 - DNA, 497 bp, Homo sapiens; identical to SEQ ID NO: 536376
  misc_feature: HIJSMM301DDCZC.22.9.A09.1.454.light.4.raw

SEQ ID NO: 556589 - DNA, 496 bp, Homo sapiens; identical to SEQ ID NO: 537925
  misc_feature: HIJSMM301B9M5J.22.14.B03.1.454.light.4.raw

SEQ ID NO: 556590 - DNA, 510 bp, Homo sapiens; identical to SEQ ID NO: 552214
  misc_feature: HIJSMM301ALHU3.43.67.G01.1.454.light.4.raw

SEQ ID NO: 556591 - DNA, 492 bp, Homo sapiens
  misc_feature: HIJSMM301E25PY.43.72.G06.1.454.light.4.raw
tgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtggccgcctatgagttgactcagccaccctcagtgtccgtgtccccaggacagacagccagcatcacctgctctggagataaattgggggataaatatgcctcctggtatcagcagaagccaggcgagtcccctgtgttggtcatctatcaagatgacaaacggccctcagggatccctgagcgattctctggctccaactctgggaacacagccactctgaccatcagcgggacccaggctatggatgaggctgacttttactgtcaggcgtgggacaccaacactgtggttttcggcggagggaccaagctgaccgtcctaggtcagcccaagctgccccctcggtca

SEQ ID NO: 556592 - DNA, 481 bp, Homo sapiens; identical to SEQ ID NO: 535993
  misc_feature: HIJSMM301BP9TL.21.25.C03.1.454.light.4.raw

SEQ ID NO: 556593 - DNA, 505 bp, Homo sapiens
  misc_feature: HIJSMM301DEPGC.19.78.H01.1.454.light.4.raw
tactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagccccaaggccaaccccactgtca

SEQ ID NO: 556594 - DNA, 482 bp, Homo sapiens
  misc_feature: HIJSMM301C3ZJA.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgaggattttgcaacttattactgtctacaagattacacttaccctggacgttcggccaaggaccgaaggtaggaaatacaaacgaactagtggctgcacca

SEQ ID NO: 556595 - DNA, 505 bp, Homo sapiens; identical to SEQ ID NO: 536254
  misc_feature: HIJSMM301BRRLE.7.71.G05.1.454.light.4.raw

SEQ ID NO: 556596 - DNA, 493 bp, Homo sapiens
  misc_feature: HIJSMM301DQ6Y4.40.12.B01.1.454.light.4.raw
tctagcgactcacgaccggtgctcgatttagtagtgtagattccgcgggggatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggcctccggggtccctgacaggttcagtggcagtggatcagtcacagattttacactgaaaatcagcagggtggaggcagaagatgttgggatttattactgcatgcaacctctacaaactgtgtggacggtcggccaagggaccaaggtggaaatcaagcgaactgtggctgcacc

SEQ ID NO: 556597 - DNA, 490 bp, Homo sapiens
  misc_feature: HIJSMM301AVXJ2.47.64.F09.1.454.light.4.raw
agctcacgtacacgaccggtgctcgatttagcgcgtatacaagggggagggaacgtgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggcggagggaccagggtggagatcaaacgactgtggctgcacatctgtcttc

SEQ ID NO: 556598 - DNA, 519 bp, Homo sapiens
  misc_feature: HIJSMM301C259R.12.71.G05.1.454.light.4.raw
atacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaagtgaccgtcctaagtcagcccaaggctgccccctcggtcactctgttcccaccct

SEQ ID NO: 556599 - DNA, 506 bp, Homo sapiens
  misc_feature: HIJSMM301AY60Q.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctcggcgacgttcggccaaggaccaaggtggaagtcaagcgaactgtggctgcaccatctgtcttcatcttcccgcc

SEQ ID NO: 556600 - DNA, 485 bp, Homo sapiens
  misc_feature: HIJSMM301CV1Z7.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactagaaaatcagcagagtggaggctgaggatgttgggctctattattgcatgcaagctctacaagtcccgctcactttcggcggagggaccaaggtggagatcaaacgaa

SEQ ID NO: 556601 - DNA, 498 bp, Homo sapiens
  misc_feature: HIJSMM301CD8AT.22.9.A09.1.454.light.4.raw
acatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcagtgggtctggaagagacttcactctcaccatcaacagcctagagcctgacgattctgcagtttattactgtcagcagcgtaccaagtggcctccgacttttggccagggggccaagctggagatcagacgaactgtggctgcaccatctgtctttcatcttccccg

SEQ ID NO: 556602 - DNA, 444 bp, Homo sapiens; identical to SEQ ID NO: 535192
  misc_feature: HIJSMM301AH4HY.5.9.A09.1.454.light.4.raw

SEQ ID NO: 556603 - DNA, 486 bp, Homo sapiens; identical to SEQ ID NO: 535523
  misc_feature: HIJSMM301APPWO.22.73.G07.1.454.light.4.raw

SEQ ID NO: 556604 - DNA, 505 bp, Homo sapiens; identical to SEQ ID NO: 539292
  misc_feature: HIJSMM301EUI23.19.85.H08.1.454.light.4.raw

SEQ ID NO: 556605 - DNA, 515 bp, Homo sapiens
  misc_feature: HIJSMM301BK8KA.17.33.C11.1.454.light.4.raw
  modified_base (506)..(506): a, c, t, g, unknown or other
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccnccctcctcc

SEQ ID NO: 556606 - DNA, 516 bp, Homo sapiens
  misc_feature: HIJSMM301B70PQ.9.2.A02.1.454.light.4.raw
tgatacgtctcacgaccggtgctcgatttagactcatctacaggggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacgaatagcgacattggtggctctaatcatgtctcctggtactataacagtccaggcaaagcccccaaactcataatttatgatgtctttagacggccctcagggatttcttctcggttgtctggctccaagtctgggaacacggcctccctgaccatctctggacttcagcctgaggacgagggtgattacttctgcagttcagattcagaaacttcccctcgttgggtgttcggcggagggaccatgctgaccgtcctgagtcagcccaaggctgccccctcggtcactctgttcccgcct

SEQ ID NO: 556607 - DNA, 511 bp, Homo sapiens
  misc_feature: HIJSMM301BVZLZ.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacccctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccg

SEQ ID NO: 556608 - DNA, 486 bp, Homo sapiens; identical to SEQ ID NO: 535043
  misc_feature: HIJSMM301DRM2M.46.35.D02.1.454.light.4.raw

SEQ ID NO: 556609 - DNA, 498 bp, Homo sapiens
  misc_feature: HIJSMM301CL0TI.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgccccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtgaggctgaggatgttgcggtttattactgcctgcagagtattcactggccgtggacgttcggccaagggaccaaggtggaaatcaaacgaactgtggctgcacc

SEQ ID NO: 556610 - DNA, 526 bp, Homo sapiens
  misc_feature: HIJSMM301BLMXE.18.59.F04.1.454.light.4.raw
  modified_base (441)..(441): a, c, t, g, unknown or other
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaacgnacgcactctaatcgttcggtaccggtaggtaccggaacggtacgacccgtacccgttacggtacgacgacccgaccggaaccgaa

SEQ ID NO: 556611 - DNA, 493 bp, Homo sapiens
  misc_feature: HIJSMM301ELNS8.49.26.C04.1.454.light.4.raw
agtcgagagacacgaccggtgctcgatttagtctagcgactttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttaggagcaacttagcctggtatcagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataatgtccgggctccggacactttcggcggagggaccaaggtggagatcaaacgaactgtggctgcaccatctgt

SEQ ID NO: 556612 - DNA, 495 bp, Homo sapiens; identical to SEQ ID NO: 535821
  misc_feature: HIJSMM301DW80J.3.31.C09.1.454.light.4.raw

SEQ ID NO: 556613 - DNA, 503 bp, Homo sapiens
  misc_feature: HIJSMM301ETHPY.47.55.E11.1.454.light.4.raw
agctcacgtacacgaccggtgctcgatttagcactcgcacgtagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatggggctgattattactgtgtaggttgggatcgcagcctgactgcttacgtcttcggagctgggatcaaggtcaccgtcctagggcacgtgagactcaggaaatgaccagaggggagtgaatgaggggtgcagagaactccatggctaccaggtcagcccaaggccaaccccactgtcactctgttcccaccctcctcta

SEQ ID NO: 556614 - DNA, 448 bp, Homo sapiens; identical to SEQ ID NO: 538166
  misc_feature: HIJSMM301CGXT7.18.9.A09.1.454.light.4.raw

SEQ ID NO: 556615 - DNA, 512 bp, Homo sapiens
  misc_feature: HIJSMM301CZQWB.19.59.F04.1.454.light.4.raw
tactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggaagaatttttgtgtcctggtaccagcagctcccaggaacagcccccaaactcctcatttttgacaataataagcgaccctcagggattcctgaccgattctctggctccaagtctggcacgtcagccaccctgggcatcaccggactccagactggggacgaggccgattattactgcggaacatgggatagcagcctgagtactgtgataatcggcggagggaccaagctgaccgtcctaggtcagcccaaggctgccccctcggtcactctgttcccta

SEQ ID NO: 556616 - DNA, 514 bp, Homo sapiens
  misc_feature: HIJSMM301B8YU0.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctacttactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctctgttttctggctccatcgacgggtcctccactactgcctccttcaccatctctggactgaagactgaggacgaggctgactactactgtcagtcttatgataacaccagggtggtgttcggcggagggaccaagctggccgtcctaggtcagcccaaggctgccccctcggtcactctgttcccgccctcctcgagtagtaca

SEQ ID NO: 556617 - DNA, 502 bp, Homo sapiens
  misc_feature: HIJSMM301DOO03.48.23.C01.1.454.light.4.raw
agtatacatacacgaccggtgctcgatttagtacacgtgattagggattgggggcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccggtcagagtgtcaccatctcttgttctggaagcggctccaacatcggaagaaatactgtgaactggtaccagcagctcccaggagcggcccccagactctacatctataataattatcgccggccctcaggggtccctgaccgagtctctgcctccaagtctggcacctcagcctccctggccatcagtggcctccggtctgaagaggagggtgattattactgtgcagcgtgggatgacagcctgaatgcttgggtgttcggcggagggaccaagttgaccgtcctaggtcaacccaaggctg

SEQ ID NO: 556618 - DNA, 495 bp, Homo sapiens; identical to SEQ ID NO: 535821
  misc_feature: HIJSMM301DH4CV.3.31.C09.1.454.light.4.raw

SEQ ID NO: 556619 - DNA, 495 bp, Homo sapiens
  misc_feature: HIJSMM301B7Z1Z.22.86.H09.1.454.light.4.raw
acatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagtcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgaccgtcctaggtcagcccaaggctgcccctcggtcactctgttcccgcctcct

SEQ ID NO: 556620 - DNA, 485 bp, Homo sapiens; identical to SEQ ID NO: 538956
  misc_feature: HIJSMM301DQJG9.40.69.G03.1.454.light.4.raw

SEQ ID NO: 556621 - DNA, 513 bp, Homo sapiens
  misc_feature: HIJSMM301ERY1W.9.20.B09.1.454.light.4.raw
tgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaggaagagtgtccactggtaccaacagaggccaggccgggcccctgtggtggtcgtctatgataacagtgaccggccctcgtcgatccctgagcgcttctctggctccaactctgggaacacggccaccctgaccatcagcagggccgaagccggggatgaggccgactattactgccaggtgtggcatattatcacccccgtgttcggcgggggaccgaagctgaccgtcctaggtcagccaaggctgccccctcgtcactctgttcccgccctcctcacgacgtatc

SEQ ID NO: 556622 - DNA, 484 bp, Homo sapiens
  misc_feature: HIJSMM301BEIIU.43.24.C02.1.454.light.4.raw
tgtgagtagtcacgaccggtgctcgatttagtacagatcgttagggaaagggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatagaaacaactatttggattggtatctgcagaagccagggcagcctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccgctcactttcggcggagggaccaaggtggagatacaaacgaa

SEQ ID NO: 556623 - DNA, 509 bp, Homo sapiens; identical to SEQ ID NO: 536047
  misc_feature: HIJSMM301B2J1D.17.33.C11.1.454.light.4.raw

SEQ ID NO: 556624 - DNA, 478 bp, Homo sapiens
  misc_feature: HIJSMM301A136W.52.1.A01.1.454.light.4.raw
cgcagtacgacacgaccggtgctcgatttagacgtctcatcaggggcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtggggtcccatcaaggttcagtggcagtggatctgggacagaattcactctcaccatcaccagtctgcaggctgaggattttgcaacttacttctgtcaacagagttacagttccctcactttcggccctgggaccatagtggatatcaaacgaactgtggctgcaccactctgtctt

SEQ ID NO: 556625 - DNA, 491 bp, Homo sapiens; identical to SEQ ID NO: 535176
  misc_feature: HIJSMM301AKUMR.13.39.D06.1.454.light.4.raw

SEQ ID NO: 556626 - DNA, 483 bp, Homo sapiens
  misc_feature: HIJSMM301AM9AR.4.1.A01.1.454.light.4.raw
  modified_base (416)..(416): a, c, t, g, unknown or other
agcactgtagcacgaccggtgctcgatttagacgtctcatcagggggaggaactgctcagttaggacccagacggaaccatggaagccccagcgcagcttctcttcctcctgctactctggctcccagaatccgctggagaaatcgtagtgacgcagtctccagccaccctgtctgtgtctccaggggagagagccaccctctcctgcagggccaatcagagtattggtcacagcttagcctggtaccagcagaaacctggccaggctcccggtctcctcatctctgctgcgtccatcagggccactggtatccctgccaggttccgtggcagtgggtctgggacagagttcactctcaccatcagcagcctgcagtctgatgatgttgcagtttattactgtcatcaatatggtnaccggcccacgttcggccaagggaccaaggtggaaatcaaacgaactgtggctgcaccatctgtctt

SEQ ID NO: 556627 - DNA, 516 bp, Homo sapiens
  misc_feature: HIJSMM301CO5O1.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggtccaaggaccgaacggtaggaaggtacaaacgaactagtggcgtgcaccatctgtcttctactcttcccgtcccact

SEQ ID NO: 556628 - DNA, 499 bp, Homo sapiens; identical to SEQ ID NO: 536578
  misc_feature: HIJSMM301A8SW1.22.27.C05.1.454.light.4.raw

SEQ ID NO: 556629 - DNA, 487 bp, Homo sapiens; identical to SEQ ID NO: 537079
  misc_feature: HIJSMM301EYCI4.14.55.E11.1.454.light.4.raw

SEQ ID NO: 556630 - DNA, 492 bp, Homo sapiens
  misc_feature: HIJSMM301AVNC3.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattctccagcgttcggccgagggaccgaaggtaggaagtcaagacgaactgtggctgcaccatctgtt

SEQ ID NO: 556631 - DNA, 463 bp, Homo sapiens
  misc_feature: HIJSMM301BFB4F.18.59.F04.1.454.light.4.raw
tacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaacccactgtcactctgttcccgccctcctccatactcgta

SEQ ID NO: 556632 - DNA, 447 bp, Homo sapiens; identical to SEQ ID NO: 535020
  misc_feature: HIJSMM301DMVXO.18.9.A09.1.454.light.4.raw

SEQ ID NO: 556633 - DNA, 514 bp, Homo sapiens; identical to SEQ ID NO: 541418
  misc_feature: HIJSMM301BTWLG.17.33.C11.1.454.light.4.raw

SEQ ID NO: 556634 - DNA, 489 bp, Homo sapiens
  misc_feature: HIJSMM301BYB59.14.55.E11.1.454.light.4.raw
  modified_base (480)..(480): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactaactgtcaacagagttacagtacccccctcactttcgcggagggaccgaagacggagatcagacgaactgtgcgtgcaccanctgtcttct

SEQ ID NO: 556635 - DNA, 491 bp, Homo sapiens; identical to SEQ ID NO: 540256
  misc_feature: HIJSMM301AZW9J.46.67.G01.1.454.light.4.raw

SEQ ID NO: 556636 - DNA, 473 bp, Homo sapiens
  misc_feature: HIJSMM301CIGN2.49.76.G10.1.454.light.4.raw
agtcgagagacacgaccggtgctcgatttagtcactcatacagggggagtcagtctcagtcaggacacagcatggacatgagggtccccgctcagctcctggggctcctgctactctggctccgaggtgccagatgtgacatccagatgacccagtctccttcctccctgtctgcatctataggagacagaatcaccatcacttgccgggcgagtcgagacattagcatgtatctgaattggtatcagcaaaaaccagggacagcccctaaactcctgatcctcgatgcatccactttggagacaggggtcccatcaaggttcagtggaagtggctctgggacagattttactttcaccatcagcaggctgcagcctgaagatattgcaacatattactgtcaacagtatgatcgcctcccgctcactttcggcgggggaccgaaggtggagatcaagcgaactgtggctgca

SEQ ID NO: 556637 - DNA, 511 bp, Homo sapiens; identical to SEQ ID NO: 537464
  misc_feature: HIJSMM301EF6BC.7.34.D01.1.454.light.4.raw

SEQ ID NO: 556638 - DNA, 494 bp, Homo sapiens; identical to SEQ ID NO: 550130
  misc_feature: HIJSMM301CSNUG.12.38.D05.1.454.light.4.raw

SEQ ID NO: 556639 - DNA, 508 bp, Homo sapiens; identical to SEQ ID NO: 541988
  misc_feature: HIJSMM301ARL8J.5.60.F05.1.454.light.4.raw

SEQ ID NO: 556640 - DNA, 502 bp, Homo sapiens; identical to SEQ ID NO: 537363
  misc_feature: HIJSMM301COD4S.18.23.C01.1.454.light.4.raw

SEQ ID NO: 556641 - DNA, 473 bp, Homo sapiens
  misc_feature: HIJSMM301B8JOL.51.57.F02.1.454.light.4.raw
cgatcgtatacacgaccggtgctcgatttagctcgatatagttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagagaccagggaaagcccctaacctcctgatctatgatgcatccaatttggaaagtggggtcccatcaaggttcagtggcagtggatctgggacagatttcactctcaccatcagcagtgtgcgacctgaagattttgcaacttactactgtcaacagagttacagtacccctcagctcactttcggcggagggaccaaggtggagatcaaacgaactgtgg

SEQ ID NO: 556642 - DNA, 515 bp, Homo sapiens
  misc_feature: HIJSMM301B4XW1.48.66.F11.1.454.light.4.raw
agtatacatacacgaccggtgctcgatttagtcacgcgagaaaggggggaagcctgagaacacttagccttcatgagtgtccccaccatggcctggatgatgcttctcctcggactccttgcttatggatcaggcgtgcattctcagagtgtggtgacccaggaaccatcgttctcagtgtcccctggagggacagtcacactcacttgtggcttgacttctggctcagtcgcgccggtccactaccccagttggtaccaacagatcccaggccaggctccacgcacgctcatcttcatgaaacagattcgctcttctggggtccctgatcggtttctggctccatcgttggggcaaagccgccctcaccatcacgggggcccaggcagaggatgaggcgaattattattgtatgctccacaggggcaggggcacctgggagttcggcggcgggaccaagctgaccgtcctaggtcagcccaaggctcgccccctcggtcacctctcgttcccgt

SEQ ID NO: 556643 - DNA, 491 bp, Homo sapiens
  misc_feature: HIJSMM301AZIGO.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacagggtcccatcaaggttcagtggaggtggatctgggacagattttactctcggcatccgcagcctgcagcctgaagattttgcgacatattactgtcaacagtatagaaaatgtcccgctcactttcggcgggggaccgaaggtggagttcaacgaactgtggctgcaccatctgtcttc

SEQ ID NO: 556644 - DNA, 484 bp, Homo sapiens; identical to SEQ ID NO: 535400
  misc_feature: HIJSMM301C5XEL.46.26.C04.1.454.light.4.raw

SEQ ID NO: 556645 - DNA, 506 bp, Homo sapiens; identical to SEQ ID NO: 553862
  misc_feature: HIJSMM301DQQSF.10.88.H11.1.454.light.4.raw

SEQ ID NO: 556646 - DNA, 503 bp, Homo sapiens; identical to SEQ ID NO: 538583
  misc_feature: HIJSMM301ETM0Q.15.59.F04.1.454.light.4.raw

SEQ ID NO: 556647 - DNA, 494 bp, Homo sapiens
  misc_feature: HIJSMM301CMYUE.13.46.E02.1.454.light.4.raw
tcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatcagcagggtggaggctgaggatgttattgggctctattattgcatgcaagcaacacactggccgtacacttttggccaggggaccaagctggagatcaatcgaactgtggcg

SEQ ID NO: 556648 - DNA, 517 bp, Homo sapiens; identical to SEQ ID NO: 536980
  misc_feature: HIJSMM301EBH00.5.27.C05.1.454.light.4.raw

SEQ ID NO: 556649 - DNA, 498 bp, Homo sapiens
  misc_feature: HIJSMM301EF0LV.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcgacggggtcccctcgaggttcagtggcagtggatctgggacactatttccaccctcaccatcaatagcctggaagctgaagatgctgcaacttattactgtcatcagagtactactttacctcaagtgatcaccttcggccaagggacacgactggagattaaacgaactgtggctgcaccatctgtctt

SEQ ID NO: 556650 - DNA, 500 bp, Homo sapiens; identical to SEQ ID NO: 539563
  misc_feature: HIJSMM301BBL36.8.2.A02.1.454.light.4.raw

SEQ ID NO: 556651 - DNA, 506 bp, Homo sapiens
  misc_feature: HIJSMM301D0APM.14.57.F02.1.454.light.4.raw
cgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggcccaccggcatcccagccaggttcagtggcagcgggtctgggacagacttcactctcaccatcagcagcctagagtctgaagattttgctagtttattactgtcagcagcggggcaattggccgctcactttcggcgggggaccgaaggtggagttcaaacgaactgtggctgcaccatctgtcttcatcttcccgccta

SEQ ID NO: 556652 - DNA, 510 bp, Homo sapiens
  misc_feature: HIJSMM301DL3CE.17.28.C06.1.454.light.4.raw
cgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggctcgccccctc

SEQ ID NO: 556653 - DNA, 488 bp, Homo sapiens
  misc_feature: HIJSMM301D8BBR.22.6.A06.1.454.light.4.raw
acatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgccaaatcaatatgctttttggtatcaacagaggccaggccacgcccctgtcttaatgatatataaagacagtgagaggccctcagggatctctgagcgattctctgcctccagctcagggacaacattcacattgaccatcagtgaagtccaaggcagaagatgaggctgactattattgtcaatcaacagacagtagtgggaaatatgtggtattcggcggagggaccaaactgaccgtcctaggtcagcccaaggctcgtccccccg

SEQ ID NO: 556654 - DNA, 519 bp, Homo sapiens
  misc_feature: HIJSMM301DVF4E.41.25.C03.1.454.light.4.raw
tctatactatcacgaccggtgctcgatttagtagtgtagatttgggtttgggggatagctcaggaagcagagcctggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctggggtcccctttcggtttctggctccatcgacagtccctccaactccgcctcccttaccatatctgggctgaagagtgaggacgaggctgactacttctgtcagtcttatgatataaacaattatgtgataattggcgggagggaccagggtgaccgtcctaggtcagcccaaggctgccccctcggtcactctcgttcccg

SEQ ID NO: 556655 - DNA, 305 bp, Homo sapiens; identical to SEQ ID NO: 544328
  misc_feature: HIJSMM301AYSE5.49.19.B08.1.454.light.4.raw

SEQ ID NO: 556656 - DNA, 495 bp, Homo sapiens
  misc_feature: HIJSMM301DW5VY.51.83.H06.1.454.light.4.raw
cgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaagagccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacagacttcgctctcaccatcagcagcctagagcctgaagattttgcagtttattattgtcagcagcgaaacaactggcctccttggacgttcggccaagggaccaaggtggaaatcaaacgaactgtggctgcaccatctgtcttcat

SEQ ID NO: 556657 - DNA, 510 bp, Homo sapiens
  misc_feature: HIJSMM301CP1GH.43.23.C01.1.454.light.4.raw
tgtgagtagtcacgaccggtgctcgatttagtacacgtgattagggattgggggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcggggcaaagctgccctgacactgtcaggtgtgcagcctgaggacgaggctgactattactgcctgctcatatatggtggcgcgtgggtgttcggcggaggaccaagctgaccgtctgggtcagcccaaggctgccccctggtcactctgttcccgccctctca

SEQ ID NO: 556658 - DNA, 486 bp, Homo sapiens; identical to SEQ ID NO: 535481
  misc_feature: HIJSMM301AHKV4.17.21.B10.1.454.light.4.raw

SEQ ID NO: 556659 - DNA, 454 bp, Homo sapiens; identical to SEQ ID NO: 534964
  misc_feature: HIJSMM301D7WIC.19.86.H09.1.454.light.4.raw

SEQ ID NO: 556660 - DNA, 488 bp, Homo sapiens
  misc_feature: HIJSMM301BGWWN.12.88.H11.1.454.light.4.raw
atacgacgtacacgaccggtgctcgatttagcgacagcgagaacacaacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccgggtggggctgaggatgttggcatttattactgcatgcaggctatacacttcctgccacttttggccaggggaccaagctggagatcaggcgtaacg

SEQ ID NO: 556661 - DNA, 502 bp, Homo sapiens
  misc_feature: HIJSMM301AQ6ES.13.11.A11.1.454.light.4.raw
tcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggagtccccagccgcttctctggatccaaggatgattccgccaacgcagggatattactcatctctgggctccagtctgacgatgaggctgactattactgtttgacttggcacaacaacgcctggatcttcggacctgggaccacggtcaccgtcctaggtcagcccaaggccaacccccactgtcactctgtt

SEQ ID NO: 556662 - DNA, 454 bp, Homo sapiens; identical to SEQ ID NO: 535005
  misc_feature: HIJSMM301A6J8Q.19.86.H09.1.454.light.4.raw

SEQ ID NO: 556663 - DNA, 491 bp, Homo sapiens
  misc_feature: HIJSMM301CQMFE.12.23.C01.1.454.light.4.raw
atacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaagagccaccctctcctgcagggccagtcagagtgttaatagcgacttagcctggtaccagcagatacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcagcagtataataactggttcctgctcactttcggcgggggaccaggtggagatcaaacgaactgtgctgcaccatctgtt

SEQ ID NO: 556664 - DNA, 505 bp, Homo sapiens
  misc_feature: HIJSMM301ESQ8T.22.15.B04.1.454.light.4.raw
acatacgcgtcacgaccggtgctcgatttagacagtatatatccgcggggggggtcgtcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacaacacccaggcaaagcccccaaactcatgatttatgaggtcactaagcggccctcaggggtccctgatcgcttctctggctccaagtctggcaacacggcctccctgaccgtctctgggctccaggctgaggatgaggctgattattactgcagctcatatggaggcagcgacaatttggttgttcggcggagggaccaagctgaccgtcctaggtcagcccaaggctgccccctccggtc

SEQ ID NO: 556665 - DNA, 488 bp, Homo sapiens; identical to SEQ ID NO: 537124
  misc_feature: HIJSMM301CKEB3.11.25.C03.1.454.light.4.raw

SEQ ID NO: 556666 - DNA, 444 bp, Homo sapiens; identical to SEQ ID NO: 535594
  misc_feature: HIJSMM301ERD3Q.9.9.A09.1.454.light.4.raw

SEQ ID NO: 556667 - DNA, 447 bp, Homo sapiens; identical to SEQ ID NO: 535020
  misc_feature: HIJSMM301DR0WT.18.9.A09.1.454.light.4.raw

SEQ ID NO: 556668 - DNA, 479 bp, Homo sapiens; identical to SEQ ID NO: 536513
  misc_feature: HIJSMM301CF59F.40.8.A08.1.454.light.4.raw

SEQ ID NO: 556669 - DNA, 441 bp, Homo sapiens; identical to SEQ ID NO: 534971
  misc_feature: HIJSMM301C2EV8.11.3.A03.1.454.light.4.raw

SEQ ID NO: 556670 - DNA, 490 bp, Homo sapiens; identical to SEQ ID NO: 535234
  misc_feature: HIJSMM301BPTEV.17.21.B10.1.454.light.4.raw

SEQ ID NO: 556671 - DNA, 479 bp, Homo sapiens; identical to SEQ ID NO: 540873
  misc_feature: HIJSMM301EO1MR.40.59.F04.1.454.light.4.raw

SEQ ID NO: 556672 - DNA, 479 bp, Homo sapiens
  misc_feature: HIJSMM301DZ1DZ.49.8.A08.1.454.light.4.raw
agtcgagagacacgaccggtgctcgatttagcatactctacagggggcaggagtcagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatctaccactcactttcgcggagggaccacggtggaggatcaaacgaactgtggctgcacc

SEQ ID NO: 556673 - DNA, 520 bp, Homo sapiens; identical to SEQ ID NO: 539176
  misc_feature: HIJSMM301D9LBX.27.23.C01.1.454.light.4.raw

SEQ ID NO: 556674 - DNA, 515 bp, Homo sapiens; identical to SEQ ID NO: 541455
  misc_feature: HIJSMM301A85XF.17.33.C11.1.454.light.4.raw

SEQ ID NO: 556675 - DNA, 500 bp, Homo sapiens
  misc_feature: HIJSMM301C0OCS.8.1.A01.1.454.light.4.raw
ctcgcgtgtccacgaccggtgctcgatttagacgtctcatcagggggtgggctcaggaggcagagctctgggaatctcaccatggcctggaccactctcctgctccccctcctcactttctgcacagtctctgaggcctcctatgagctgacacagccaccctcggtgtcagtgtccccaggacaaacggccaggatcacctgctctggagatgaattgccaaagaaatatgcttattggtaccagcagaagtcaggccaggcccctgtcctggtcatttatgaggacaagaaacgaccctccgggatccctgacagactctctggctccagctcagggacagtggccaccttgactatcactggggcccaggtggaggatgaaggagactactattgttactctccagagaaggatggtcatcattgggtgttcggcggagggaccaagctgaccgtcctaagtcagcccaaggctgccccctggtcactctgttccca

SEQ ID NO: 556676 - DNA, 501 bp, Homo sapiens
  misc_feature: HIJSMM301CZG14.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctccagacgttcggccaaggaccgaagtaggaaatacaaacgaactagtggcgtgcacca

SEQ ID NO: 556677 - DNA, 481 bp, Homo sapiens; identical to SEQ ID NO: 535993
  misc_feature: HIJSMM301EGVCF.21.25.C03.1.454.light.4.raw

SEQ ID NO: 556678 - DNA, 462 bp, Homo sapiens
  misc_feature: HIJSMM301ADRGY.10.9.A09.1.454.light.4.raw
catagtagtgcacgaccggtgctcgatttagcgagacgcgcagggggaggaactgctcagttaggacccagagggaaccatggaagccccagctcagcttctcttcctcctgctactctggctcccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctgggaccaaagtggagatcaaacgaactagtggctgcaccatctgtcttcatcttccgccatctgacactactat

SEQ ID NO: 556679 - DNA, 501 bp, Homo sapiens
  misc_feature: HIJSMM301BLG2C.49.34.D01.1.454.light.4.raw
agtcgagagacacgaccggtgctcgatttagatcgtctgtgttgggtttgggggctgtgggtccaggaggcagaactctgggtgtctcaccatggcctggatccctctacttctccccctcctcactctctgcacaggctctgaggcctcctctgaattgcaacagacatcctcggtgtcagcgtccccaggacagacggccagaattacttgctctggagatgcattggcgaaacaatttgcttcttggttccagcagaagccaggccaagcccctatcttgatgatctataaaggctctgagaggccctcagggatccctgagcgattctctgggtcccactcaggggccacagccgtgttgaccatcactggagtccaggcagaagacgaggctgactattattgtcagtcagccgacaacactattgtctccgtgtttttcggcggagggaccaggctgaccgtcctgggtcagcccaaggctgccccctcggtcta

SEQ ID NO: 556680 - DNA, 447 bp, Homo sapiens; identical to SEQ ID NO: 535201
  misc_feature: HIJSMM301D09Q5.18.9.A09.1.454.light.4.raw

SEQ ID NO: 556681 - DNA, 506 bp, Homo sapiens
  misc_feature: HIJSMM301AH2RG.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccagggacaaggtggaagtcaagcgaactgtggctgcaccatctgtcttcatcttcccgcc

SEQ ID NO: 556682 - DNA, 515 bp, Homo sapiens
  misc_feature: HIJSMM301C6F3S.40.12.B01.1.454.light.4.raw
tctagcgactcacgaccggtgctcgatttagtagtgtagattccgcggggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaactacacccaggcaaagcccccaaactcatgatttctgacgtcagtaagcggccctcaggggtccctgatcgcttctctggctccaagtctggcaacacggcctccctgaccgtctctgggctccaggctgaagatgaggctgattattactgctactcgtatgcaggcggcaacaattgggtcttcggcggagggaccaagctgaccgtcctaggtcagcccaaggctgccccctcggtcactctgttccca

SEQ ID NO: 556683 - DNA, 502 bp, Homo sapiens
  misc_feature: HIJSMM301CHI1O.52.34.D01.1.454.light.4.raw
cgcagtacgacacgaccggtgctcgatttagatcgtctgtgttgggtttgggggaggaactgctcagttaggacccagagggaaccatggaagccccagctcagcttctcttcctcctgctactctggctcccagataccaccggagaagttgtattgacacagtctccagccaccctgtctttgtctccgaggggggagagccaccctctcctgcagggccagtcagagtgttggcaacctcttagcctggtaccaacaaaaacctggccaggctcccaggctcctcatctatgatgcatccacgagggccactggcatcccagccaggttcagtggcagtgggtctgagacagacttcactctcaccatcagtggcctcgagcctgaagattttgcagtttattactgtcagcagcgtagccactggctctctttcggcggagggaccaaggttgagatcaaacgaactgtggctgcaccatctgtcttcatcttccccg

SEQ ID NO: 556684 - DNA, 361 bp, Homo sapiens; identical to SEQ ID NO: 540413
  misc_feature: HIJSMM301CB60B.3.57.F02.1.454.light.4.raw

SEQ ID NO: 556685 - DNA, 489 bp, Homo sapiens; identical to SEQ ID NO: 549527
  misc_feature: HIJSMM301C43S6.15.49.E05.1.454.light.4.raw

SEQ ID NO: 556686 - DNA, 471 bp, Homo sapiens; identical to SEQ ID NO: 536321
  misc_feature: HIJSMM301CEHV1.15.8.A08.1.454.light.4.raw

SEQ ID NO: 556687 - DNA, 494 bp, Homo sapiens; identical to SEQ ID NO: 539894
  misc_feature: HIJSMM301BRLMG.16.53.E09.1.454.light.4.raw

SEQ ID NO: 556688 - DNA, 503 bp, Homo sapiens
  misc_feature: HIJSMM301BF5V8.9.71.G05.1.454.light.4.raw
tgatacgtctcacgaccggtgctcgatttagtgtcgtcgcaagagagagggggctttgcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcggagggaccaggctgaccgtcctgagtcagcccaaggctgccccctcggtcactctgttccccaccctccctcagacgtatca

SEQ ID NO: 556689 - DNA, 453 bp, Homo sapiens; identical to SEQ ID NO: 536287
  misc_feature: HIJSMM301DIJ93.19.86.H09.1.454.light.4.raw

SEQ ID NO: 556690 - DNA, 494 bp, Homo sapiens; identical to SEQ ID NO: 536810
  misc_feature: HIJSMM301BE3ZW.10.79.H02.1.454.light.4.raw

SEQ ID NO: 556691 - DNA, 491 bp, Homo sapiens; identical to SEQ ID NO: 535294
  misc_feature: HIJSMM301D55TV.16.68.G02.1.454.light.4.raw

SEQ ID NO: 556692 - DNA, 520 bp, Homo sapiens; identical to SEQ ID NO: 535686
  misc_feature: HIJSMM301DWEKH.41.19.B08.1.454.light.4.raw

SEQ ID NO: 556693 - DNA, 486 bp, Homo sapiens; identical to SEQ ID NO: 535043
  misc_feature: HIJSMM301CUK8T.46.35.D02.1.454.light.4.raw

SEQ ID NO: 556694 - DNA, 504 bp, Homo sapiens; identical to SEQ ID NO: 538940
  misc_feature: HIJSMM301EOB08.2.35.D02.1.454.light.4.raw

SEQ ID NO: 556695 - DNA, 486 bp, Homo sapiens; identical to SEQ ID NO: 535043
  misc_feature: HIJSMM301DMVV5.46.35.D02.1.454.light.4.raw

SEQ ID NO: 556696 - DNA, 496 bp, Homo sapiens
  misc_feature: HIJSMM301DX0L7.9.67.G01.1.454.light.4.raw
tgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtgcgtccagcagggccactggtatcccggccaggttcagtggtagtgggtctgggacagagttcgttctcaccatcagcagcctgcagtctgaagattttgcagtttattactgtcagcactataatagttggccgctcactttcggcgagggaccaaggtggagctcaaacgaactgtggctgcaccatctgtcttcatt

SEQ ID NO: 556697 - DNA, 484 bp, Homo sapiens; identical to SEQ ID NO: 535868
  misc_feature: HIJSMM301E0518.11.76.G10.1.454.light.4.raw

SEQ ID NO: 556698 - DNA, 490 bp, Homo sapiens
  misc_feature: HIJSMM301CA23K.15.3.A03.1.454.light.4.raw
  modified_base (431)..(431): a, c, t, g, unknown or other
tctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtatcagaaaaaccaggacagcctcctaagctgctcatttactgggcatctacccgggaatccggggtccctgaccgattcagtggcagcgggtctggcacagatttcactctcaccatcagcagcctgcaggctgaagatgtggcagtttattactgtcagcaatatgaaagtnttccttttacttcggccctgggaccaaagtggatatcaaacgaactgtggctgcaccat

SEQ ID NO: 556699 - DNA, 469 bp, Homo sapiens
  misc_feature: HIJSMM301BPKII.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcacttcgccctgggactgaagtgcatatgaagagaactgtgg

SEQ ID NO: 556700 - DNA, 486 bp, Homo sapiens; identical to SEQ ID NO: 535043
  misc_feature: HIJSMM301C5QKJ.46.35.D02.1.454.light.4.raw

SEQ ID NO: 556701 - DNA, 490 bp, Homo sapiens; identical to SEQ ID NO: 540409
  misc_feature: HIJSMM301BRQ4A.15.8.A08.1.454.light.4.raw

SEQ ID NO: 556702 - DNA, 485 bp, Homo sapiens
  misc_feature: HIJSMM301DAGBG.49.3.A03.1.454.light.4.raw
agtcgagagacacgaccggtgctcgatttagagagcgtcacaggggaggaactgctcagttaggacccagacggaaccatggaagccccagcgcagcttctcttcctcctgctactctggctcccagataccactggagaaatagtgatgacgcagtctccagccactttgtctgtgtctccaggggagagagccactctctcctgcaggaccagtcagagtgttaataacaagttagcctggtaccagcagagacctggccaggctcccaggctcctcatctatgatgtgtctaccagggccactggtatcccagccaggttcagtggcagtgggtctggggcggagttcactctcaccatcagcagcctgcagtctgaagattttgcagtttattactgtcagcactctaatgactggcccctgtacacttttggcccgggaccaaggtggagatcaaacgaactgtggctgcaccatctgtt

SEQ ID NO: 556703 - DNA, 488 bp, Homo sapiens; identical to SEQ ID NO: 541295
  misc_feature: HIJSMM301BPOIB.9.59.F04.1.454.light.4.raw

SEQ ID NO: 556704 - DNA, 512 bp, Homo sapiens
  misc_feature: HIJSMM301C8NRG.40.12.B01.1.454.light.4.raw
tctagcgactcacgaccggtgctcgatttagtagtgtagattccgcgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaactacacccaggcaaagcccccaaactcatgatttctgacgtcagtaagcggccctcaggggtccctgatcgcttctctggctccaagtctggcaacacggcctccctgaccgtctctgggctccaggctgaagatgaggctgattattactgctactcgtatgcaggcggcaacaattgggtcttcggcggagggaccaagctgaccgtcctaggtcagcccaaggctgccccctcggtcactctgttccc

SEQ ID NO: 556705 - DNA, 484 bp, Homo sapiens; identical to SEQ ID NO: 535441
  misc_feature: HIJSMM301DRXB8.26.60.F05.1.454.light.4.raw

SEQ ID NO: 556706 - DNA, 501 bp, Homo sapiens; identical to SEQ ID NO: 545941
  misc_feature: HIJSMM301CVMY9.21.22.B11.1.454.light.4.raw
  modified_base (460)..(460): a, c, t, g, unknown or other

SEQ ID NO: 556707 - DNA, 525 bp, Homo sapiens
  misc_feature: HIJSMM301AKVTS.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctggtggggcaggtcacgcccaacggcccaaccccactcgtcactcttccg

SEQ ID NO: 556708 - DNA, 520 bp, Homo sapiens; identical to SEQ ID NO: 537173
  misc_feature: HIJSMM301EMK84.27.23.C01.1.454.light.4.raw

SEQ ID NO: 556709 - DNA, 423 bp, Homo sapiens; identical to SEQ ID NO: 538400
  misc_feature: HIJSMM301E09QO.9.25.C03.1.454.light.4.raw

SEQ ID NO: 556710 - DNA, 487 bp, Homo sapiens
  misc_feature: HIJSMM301CZHJP.4.64.F09.1.454.light.4.raw
agcactgtagcacgaccggtgctcgatttagcgcgtatacagggggagtcagacccagtcaggacacagcgtggacatgagggtccccgctcagctcctggggctcctgctgctctggttcccaggttccagatgcgacatccagatgacccagtctccatcttccgtgtctgcatctgtgggcgacagagtcaccatcacttgtcgggcgagtcaggacattgggacccgattagcctggtatcagcagaaaccagggaaagcccctaacctcctcatctatgctgcgtccagtttgcacagtggggtcccattgaggttcagcggcagtggttctgagacagatttcagtctcaccatccgtgacctgcagcctgaagattttgcaacttactttgtcaacagactaactcattccctcgcagttttggccaggggaccaaggtggagatcaaacgaactgtaggctgcaccatctgtcttcatt

SEQ ID NO: 556711 - DNA, 476 bp, Homo sapiens
  misc_feature: HIJSMM301EMAYB.7.67.G01.1.454.light.4.raw
cgtgtctctacacgaccggtgctcgatttagagtatacatattgggtttgggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctcccacagcggggcaggttctgatgttcactggtaccagcagcttccagggacagcccccaaactcctcatatacgagaacaccaatcggccctcaggagtccctgaccgattctctggctccaagtctggcacctcagcctccctggccatcactgggctccaggctgaggatgaggctgattattactgccagtcgtatgacagcagcctgagtgttgggtgttcggcggaggga

SEQ ID NO: 556712 - DNA, 486 bp, Homo sapiens; identical to SEQ ID NO: 535385
  misc_feature: HIJSMM301D2TXZ.19.71.G05.1.454.light.4.raw

SEQ ID NO: 556713 - DNA, 504 bp, Homo sapiens; identical to SEQ ID NO: 535561
  misc_feature: HIJSMM301BNSKG.4.57.F02.1.454.light.4.raw

SEQ ID NO: 556714 - DNA, 497 bp, Homo sapiens; identical to SEQ ID NO: 543330
  misc_feature: HIJSMM301D8DD2.9.39.D06.1.454.light.4.raw

SEQ ID NO: 556715 - DNA, 491 bp, Homo sapiens; identical to SEQ ID NO: 542310
  misc_feature: HIJSMM301DOKO3.22.65.F10.1.454.light.4.raw

SEQ ID NO: 556716 - DNA, 480 bp, Homo sapiens; identical to SEQ ID NO: 535291
  misc_feature: HIJSMM301CYNXO.22.59.F04.1.454.light.4.raw

SEQ ID NO: 556717 - DNA, 490 bp, Homo sapiens
  misc_feature: HIJSMM301DDWY9.17.86.H09.1.454.light.4.raw
cgtagactagcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactgtaaccagcagtgaccttagtgcttataactatgtctcctggtaccaacagcacccaggcaaggtccccaaagccatgatttatgaggtcagtaatcggccctcaggggtttctaatcgcttctctggctccaagtctggcaacacggcctccctcaccatctctggactccagcctgaggacgaggctgattattactgcatctcatttgtaagcagtagccttgtgttattcggcgagggaccaagctgacgtctaggtcagcccaaggctg

SEQ ID NO: 556718 - DNA, 477 bp, Homo sapiens
  misc_feature: HIJSMM301A1EJ9.11.11.A11.1.454.light.4.raw
cgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctcctaaactgctcatctcctgggcatctacccgggcacccggagtccctgaccgattcagtggcagcgggtctgggacagacttcactctcaccatcagcaacctgcaggctgaagatgtggcagtttattactgtcagcagtattgtgaagctccgctcactttcggcggagggaccgcggtggagatcagcgaactgtggctgcaccatctgtctt

SEQ ID NO: 556719 - DNA, 406 bp, Homo sapiens
  misc_feature: HIJSMM301ELV09.49.68.G02.1.454.light.4.raw
agtcgagagacacgaccggtgctcgatttagtcgatagtgaagggaaagggggtgtcagtgtccccaggacagacggccaggatcacctgctctggagaggcattggcaaaacaatatggatattggtaccggcagaagccaggccaggcccctgtgttggtaatatataaagacagggagaggcccccagggatccctgagcgatactctggctccagctcagggacaacagtcacattgaccatcagtggagtccaggcagaagacgaggctgactattactgtcaatctgcggacagcagtggttctcatgtggtattcggcggagggaccaagctgaccgtcctaggtcagcccaaggctgccccctcggtcactctgttcccaccctcctctctctcgact

SEQ ID NO: 556720 - DNA, 498 bp, Homo sapiens; identical to SEQ ID NO: 537020
  misc_feature: HIJSMM301AROMH.26.26.C04.1.454.light.4.raw

SEQ ID NO: 556721 - DNA, 489 bp, Homo sapiens; identical to SEQ ID NO: 536663
  misc_feature: HIJSMM301A917J.16.72.G06.1.454.light.4.raw

SEQ ID NO: 556722 - DNA, 484 bp, Homo sapiens
  misc_feature: HIJSMM301EBB8V.26.60.F05.1.454.light.4.raw
agactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacacagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgcagtttattactgtcagcagtatcatgactggccgctcaccttcggccaagggacacgactggagattaaacgaactgtggctgcaccat

SEQ ID NO: 556723 - DNA, 485 bp, Homo sapiens
  misc_feature: HIJSMM301DE5F9.49.76.G10.1.454.light.4.raw
agtcgagagacacgaccggtgctcgatttagtcactcatacagggggagtcagtctcagtcaggacacagcatggacatgagggtccccgctcagctcctggggctcctgctactctggctccgaggtgccagatgtgacatccagatgacccagtctccatcctccctgtctgcatctgtgggagacagagtcaccatcacttgccgggcaagtcagagcatttcctactatttaaattggtatcaacaaagacccgggaaagcccctaggctcctgatctatgctgcatccaatttgcaaagtggggtcccatcaaggttcagtgccagtggatctgggacagacttcaccctcaccatcgacagtctgcaacctgaagattttgcaacttacttctgtcaacagagtttcgcttccccctacacttttggccaggggaccaagctggcgatcaaacgaactgtggctgcaccatctgtcttc

SEQ ID NO: 556724 - DNA, 447 bp, Homo sapiens; identical to SEQ ID NO: 535020
  misc_feature: HIJSMM301AT94C.18.9.A09.1.454.light.4.raw

SEQ ID NO: 556725 - DNA, 492 bp, Homo sapiens
  misc_feature: HIJSMM301EE566.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcacttattactgccaacagtatcatcatcattgtaatttcggtggagggaccaaggtggaggtcaaacgaactgtggctgcaccatctgtcttcattcc

SEQ ID NO: 556726 - DNA, 502 bp, Homo sapiens; identical to SEQ ID NO: 539314
  misc_feature: HIJSMM301C8FTM.21.81.H04.1.454.light.4.raw

SEQ ID NO: 556727 - DNA, 500 bp, Homo sapiens
  misc_feature: HIJSMM301BY4LF.3.88.H11.1.454.light.4.raw
agacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccactttgcaaactggggtcccatccaggttcagcggcaggggatctgggacagatttcactctcaccatcagcagcctgcagcctgaagattttgcaacttactattgtcaacaggactaacagttttaccctttaattcttcggtccgaacggaacgaacgactggaggaattaaaacgtaactagttggctgcacca

SEQ ID NO: 556728 - DNA, 495 bp, Homo sapiens
  misc_feature: HIJSMM301A2FDQ.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggcggggggaccgaaggtggagttcaacgaactgtggctgcaccatctgtcttcatt

SEQ ID NO: 556729 - DNA, 495 bp, Homo sapiens; identical to SEQ ID NO: 535007
  misc_feature: HIJSMM301CAMAK.22.5.A05.1.454.light.4.raw

SEQ ID NO: 556730 - DNA, 488 bp, Homo sapiens; identical to SEQ ID NO: 544442
  misc_feature: HIJSMM301CMX6M.19.57.F02.1.454.light.4.raw

SEQ ID NO: 556731 - DNA, 453 bp, Homo sapiens; identical to SEQ ID NO: 544521
  misc_feature: HIJSMM301BD0GU.19.86.H09.1.454.light.4.raw

SEQ ID NO: 556732 - DNA, 489 bp, Homo sapiens
  misc_feature: HIJSMM301B1PQ0.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggatagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggaggaccaaggtgagatcaaacgactgtggctgcaccatctgtcttcatccttcccgcat

SEQ ID NO: 556733 - DNA, 487 bp, Homo sapiens
  misc_feature: HIJSMM301BAIPA.19.57.F02.1.454.light.4.raw
tactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgcaacttattttgtcaacaggctaacacctttcccctcactttcggcggagggaccaaggtggagatcaagcgaactgtggctgcaccat

SEQ ID NO: 556734 - DNA, 447 bp, Homo sapiens
  misc_feature: HIJSMM301ARXC5.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtcccgtgaccgattctctggctccaagtctggcacctcagcctccctggccatcactgggctccaggctgaggatgaggctgattattactgcagctcatatacaagcaccagcactctctatgtcttcggaactgggaccaaggtcaccgtcctaggtcagcccaaggccaaccccactgtcactctgttcccacccctcctccactactcgta

SEQ ID NO: 556735 - DNA, 500 bp, Homo sapiens
  misc_feature: HIJSMM301COYAD.51.26.C04.1.454.light.4.raw
cgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataatttggggtctaagtatgtttcgtggtatcaacatcacccaggccggtccccgatactgctcctctatcatgatgccaagcggccctcagggatccctgagcgattctctggctccaactctggggacacagccactctgaccatccgcgggacccaggctgtggatgaggctgactattactgtcaggcgtgggacagggaggctgcgattttcggcggagggaccagtctgaccgtcctaggtcagcccaaggctgccccctcggtcactctccg

SEQ ID NO: 556736 - DNA, 490 bp, Homo sapiens; identical to SEQ ID NO: 542534
  misc_feature: HIJSMM301AW8PY.16.68.G02.1.454.light.4.raw

SEQ ID NO: 556737 - DNA, 475 bp, Homo sapiens; identical to SEQ ID NO: 551151
  misc_feature: HIJSMM301C3CEU.13.76.G10.1.454.light.4.raw

SEQ ID NO: 556738 - DNA, 484 bp, Homo sapiens; identical to SEQ ID NO: 535441
  misc_feature: HIJSMM301D9V19.26.60.F05.1.454.light.4.raw

SEQ ID NO: 556739 - DNA, 515 bp, Homo sapiens
  misc_feature: HIJSMM301B15EO.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggaccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctcgccccctcggtcactctgttcccaccctcctccc

SEQ ID NO: 556740 - DNA, 487 bp, Homo sapiens
  misc_feature: HIJSMM301EZAJX.48.60.F05.1.454.light.4.raw
agtatacatacacgaccggtgctcgatttagtacgtcatcaggggactgatcaggacttctcagttcatcttctcaccatgaggctccctgctcagctcctggggctgctaatgctctggatccctggatccactgcgggtgttgtgttgacccaggctcccctgtctctgtccgtcacccctggacagccggccgccatgtcgtgcaattctagtcggagcctcttctatgaggacggcaggacctacttctattggtacatgcagaagccgggccggtctccacagctcctgatgtctgagatttccaggcgattccctggagtgccagagaggttcagtggcagcggagcagggacagagttcacactgaaaatcagccgggtggaggctgaggatgttggcctttattactgcatgcaaggtatcttcctcccatacacttttggcccgggaccaaggtggatctcaaagaactgtggctgca

SEQ ID NO: 556741 - DNA, 507 bp, Homo sapiens; identical to SEQ ID NO: 549050
  misc_feature: HIJSMM301AP62U.18.37.D04.1.454.light.4.raw

SEQ ID NO: 556742 - DNA, 517 bp, Homo sapiens
  misc_feature: HIJSMM301B9LGJ.27.23.C01.1.454.light.4.raw
  modified_base (506)..(506): a, c, t, g, unknown or other
agcgtcgtctcacgaccggtgctcgatttagtacacgtgattagggattgggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctccggtnactctgttccc

SEQ ID NO: 556743 - DNA, 490 bp, Homo sapiens
  misc_feature: HIJSMM301D42E2.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgtaacttactactgtcaacagagttacagtacccccctcactttcggcggagggaccaaggcggagatcagacgaactgtggctgcaccatctgtcttcatt

SEQ ID NO: 556744 - DNA, 510 bp, Homo sapiens; identical to SEQ ID NO: 538614
  misc_feature: HIJSMM301B5FWJ.19.59.F04.1.454.light.4.raw

SEQ ID NO: 556745 - DNA, 504 bp, Homo sapiens
  misc_feature: HIJSMM301DCHLP.16.49.E05.1.454.light.4.raw
tgtactactccacgaccggtgctcgatttagagcgactagcaacacacaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttgggggttataaccttgtctcctggtaccagcagcacccagacaaagcccccaaactcatgatttatgagggcaataagcggccctcaggagtttctaatcgcttctctggctccacgtctggcaacacggcctccctgacaatctctggcctccaggctgaggacgaggctgattattactgctgctcatattcaagtcgtgtcactatgctttttggcggagggaccaaggtgaccgtcctaggtcagcccaaggctgtccccccg

SEQ ID NO: 556746 - DNA, 503 bp, Homo sapiens; identical to SEQ ID NO: 543109
  misc_feature: HIJSMM301ECVIX.19.78.H01.1.454.light.4.raw

SEQ ID NO: 556747 - DNA, 483 bp, Homo sapiens
  misc_feature: HIJSMM301AI7GA.5.39.D06.1.454.light.4.raw
atcagacacgcacgaccggtgctcgatttagtgacatctcgcagttctttgggggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccaggagaggccccaaagctccttatttatgatgcctccactttgattagtggggtcccaccaacgttcagcggcagtggatctgggacagagttcactctcaccatcagcagcctgcagcctgatgatcttggaacttattactgccaacaatataatagttattggacgttcggccaggggaccaaggtcgaaatgagacgaactagtggctgcaccat

SEQ ID NO: 556748 - DNA, 496 bp, Homo sapiens
  misc_feature: HIJSMM301ADFE0.15.67.G01.1.454.light.4.raw
tctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagatttcactctcaccatcagcagcctgcagcctgaagatttcgcaacttattactgtctacaagattacaattaccctcggacgtcgtccgacgggaccgaacggtggaaagtacaaacgaaactacgtggcgtgcaccaa

SEQ ID NO: 556749 - DNA, 495 bp, Homo sapiens; identical to SEQ ID NO: 549785
  misc_feature: HIJSMM301D5GWV.12.38.D05.1.454.light.4.raw

SEQ ID NO: 556750 - DNA, 505 bp, Homo sapiens
  misc_feature: HIJSMM301CCWV5.43.15.B04.1.454.light.4.raw
tgtgagtagtcacgaccggtgctcgatttagacagtatatatccgcgggggaggaactgctcagttaggacccagacggaaccatggaagccccagcgcagcttctcttcctcctgctactctggctcccagaaaccactggagaaatagtgatgacgcagtctccagccaccctgtctttgtctccaggggaaagagccaccctctcatgcagggccagtcagagtgttagcaccaacgtggcctggtaccagcagaaacctggccagcctccccggctcctcatctctggtgcatcctccagggccactggttccccagccaggttcagtggcagtgggtctgggacagagttcactctcaccatcagcagccttcagtctgaagattttgcagtttattactgtcaccagtatcataactggcctccaagggggacttcggccaggacaaggtaggagttacaaccgaactgtggctgcaccatctgtcttcatcttcccgt

SEQ ID NO: 556751 - DNA, 488 bp, Homo sapiens
  misc_feature: HIJSMM301EUAWZ.16.72.G06.1.454.light.4.raw
tgtactactccacgaccggtgctcgatttagctacgactgcaagggaaagggggaggaactgctcagttaggacccagacggaaccatggaagccccagcgcagcttctcttcctcctgctactctggctcccagatacctctggagaaacagtgatgacgcagtctccagccaccctctctgtgtctctaggggaaagagtcaccctctcctgcagggccagtcagagtgttagcagcaacttagcctggtatcagcagaaacctggccaggctcccaggctcctcatctatgatgcatccaccagggccactggtatcccagccaggttcagtggcagtgggtttgggacagagttcactctcaccatcagcagcctgcagtctgaagattttgcagtttattactgtcagcagtataataactggcctcggtcactttcggcggagggaccaaggtggagatcaaacgaactgtggctgcaccat

SEQ ID NO: 556752 - DNA, 466 bp, Homo sapiens
  misc_feature: HIJSMM301ARAYE.3.20.B09.1.454.light.4.raw
agacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcgtctatttaaattggtatcagcacaaaccagggaaagcccctaagctcctgatctatgctgaatccactttgcaaagtggggtcccatcaaggttcagtggcagtggatctgggacagatttcactctaaccatcagcggtctgcaacctgaagattttgcaactcactactgtcaacagagtgacagcacgcctcacactttcggcggagggaccgaaggtggagatcaacgaa

SEQ ID NO: 556753 - DNA, 498 bp, Homo sapiens; identical to SEQ ID NO: 538056
  misc_feature: HIJSMM301CGHKI.15.25.C03.1.454.light.4.raw

SEQ ID NO: 556754 - DNA, 488 bp, Homo sapiens
  misc_feature: HIJSMM301AEOXR.52.53.E09.1.454.light.4.raw
  modified_base (356)..(356): a, c, t, g, unknown or other
  modified_base (446)..(446): a, c, t, g, unknown or other
cgcagtacgacacgaccggtgctcgatttagagagagtgtgttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcagggggacgtatccctgatcgcttctcaggctccggctctgggactggancgctacctcaccatctccagcctccagtctgaggacgagggtgactattactgtcagacgtgggacactggcatttgggtgttcggcggngggaccgaagttgaccgtcctacggtcagcccgaaggctccg

SEQ ID NO: 556755 - DNA, 419 bp, Homo sapiens
  misc_feature: HIJSMM301AMFX0.18.78.H01.1.454.light.4.raw
tacgagtatgcacgaccggtgctcgatttagtgtgagtagtttgggtttgggggctttgtctgggtctcctggacagtcgatcaccatctcctgtactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggaccgaggctgattattactggcagctcatatacaagcagcagcactcaagtcttcggaactgggaccaaggtcaccgtcctaggtcagccccaaggccaaccccactgtcactctgttcccgccctcctccatactcgta

SEQ ID NO: 556756 - DNA, 492 bp, Homo sapiens; identical to SEQ ID NO: 534967
  misc_feature: HIJSMM301EVSIA.47.64.F09.1.454.light.4.raw

SEQ ID NO: 556757 - DNA, 504 bp, Homo sapiens
  misc_feature: HIJSMM301CLBRL.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaagtggagtatcaaacgaactgtggctgcaccatctgt

SEQ ID NO: 556758 - DNA, 454 bp, Homo sapiens; identical to SEQ ID NO: 536449
  misc_feature: HIJSMM301DXFJ6.18.78.H01.1.454.light.4.raw

SEQ ID NO: 556759 - DNA, 486 bp, Homo sapiens
  misc_feature: HIJSMM301AO0G3.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctgttcccaccctcctccgctacgtaga

SEQ ID NO: 556760 - DNA, 507 bp, Homo sapiens
  misc_feature: HIJSMM301EHVKT.14.3.A03.1.454.light.4.raw
cgtctagtaccacgaccggtgctcgatttagagagcgtcacaggggggggtcgtcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctggtaccaacagcacccaggcaaagcccccaaactcattatttatgaggtcaataatcggccctcaggagtttctaatcgcttctctggctccaagtctggcaacacggcctccctgagcatctctgggctccaggctgaggacgaggctgattattactgcagctcatatactattagcagaactgtggttttcggtcggagggaccaaggtgaccgtcctaggtcagcccaaggctgccccctcggtcactctcg

SEQ ID NO: 556761 - DNA, 485 bp, Homo sapiens; identical to SEQ ID NO: 539315
  misc_feature: HIJSMM301C8EFP.3.88.H11.1.454.light.4.raw

SEQ ID NO: 556762 - DNA, 494 bp, Homo sapiens
  misc_feature: HIJSMM301EZ346.43.83.H06.1.454.light.4.raw
tgtgagtagtcacgaccggtgctcgatttagatcacgtgcgtcgcggggagagctgctcagttaggacccagagggaaccatggaaaccccagcgcagcttctcttcctcctgctactctggctcccagataccaccggagaaactgtgttgacgcagtctccaggcacgctgtctttgtctccaggggaaagagccaccctctcgtgtagggccagtcagagtgttatcaccgactccttagcctggtaccagcagaaacctggccaggctcccaggctcctcatatatggtgcatccagcaggatcactggcatcccagcgaggttcagtggccatgggtctgggacggagttcactctcaccatcagccgactggagcctgaagattttgcagtatattactgtcaacaatatggtagttctcctctcactttcggcggagggaccaaggtggaagtcaaacgaactgtggctgcaccatctgtcttcatt

SEQ ID NO: 556763 - DNA, 474 bp, Homo sapiens
  misc_feature: HIJSMM301A1IIU.13.76.G10.1.454.light.4.raw
tcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcaccgtccaagtcagacccg

SEQ ID NO: 556764 - DNA, 501 bp, Homo sapiens; identical to SEQ ID NO: 535873
  misc_feature: HIJSMM301DEPRS.17.27.C05.1.454.light.4.raw

SEQ ID NO: 556765 - DNA, 521 bp, Homo sapiens
  misc_feature: HIJSMM301B2F6C.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggtccgaacggaccgaacggtaggaagtacgaaacgaactagtggctgcaccatctgtcttctatcttcccgtccactctcgat

SEQ ID NO: 556766 - DNA, 507 bp, Homo sapiens
  misc_feature: HIJSMM301BF57X.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccgggggccactttcggccctgggaccaagtggatatcaaacgaactgtggctgcaccatctgtcttcta

SEQ ID NO: 556767 - DNA, 504 bp, Homo sapiens
  misc_feature: HIJSMM301ELXJB.9.12.B01.1.454.light.4.raw
tgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttgccaaggaccgaacggtaggaaagtacaaacgaactacgtggcgtgcgacca

SEQ ID NO: 556768 - DNA, 504 bp, Homo sapiens; identical to SEQ ID NO: 535077
  misc_feature: HIJSMM301CP147.8.28.C06.1.454.light.4.raw

SEQ ID NO: 556769 - DNA, 478 bp, Homo sapiens
  misc_feature: HIJSMM301D3DB0.48.29.C07.1.454.light.4.raw
  modified_base (449)..(449): a, c, t, g, unknown or other
agtatacatacacgaccggtgctcgatttagagtgctacgaagggaaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttatcactatgtctcctggtaccaacagcaccctggcaaagcccccaaactcatgatttatgatatcactaagcggccctcaggggtccctgatcgcttctctggctcccagtctggcaacacggcctccctgaccatctctgggctccaggctgaggatgaggctgattattactgctgctcatatgcaggcagctacactttggngttcggcggaggaccaagctgactgtccg

SEQ ID NO: 556770 - DNA, 503 bp, Homo sapiens
  misc_feature: HIJSMM301ALZ3F.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgacttattactgtgcatcacgggacgcaacatgggatgacaatctgagcggttgggtgttcggcggagggaccaaactgaccgtcctaggtcagcccaa

SEQ ID NO: 556771 - DNA, 502 bp, Homo sapiens
  misc_feature: HIJSMM301DESC4.48.16.B05.1.454.light.4.raw
agtatacatacacgaccggtgctcgatttagagctcacgtaagggggggtcgacaagaggcagcgctctcgggacgtctccaccatggcctgggctctgctgctcctcactctcctcactcaggacacagggtcctgggcccagtctgccctgactcagcctgcctccgtgtctgggtctcctagacaatcgattaccatctcctgcactggaaccagcagtgatattgggagtcataaccttgtctcctggtatcaacaatatccaggcagagccccccaactcataatttatgcggcctctcagcggcccccaggggtttccagtcgcttctctgcctccaagtctggcaacacggcctccttgacaatctctggcctccagcctgaggacgaggctgactattactgctgctcatatacaactatgaatgcttttttgttcggtcggagggaccaaactgaccgtcctcggtcggcccaaggctgccccctcggtcact

SEQ ID NO: 556772 - DNA, 503 bp, Homo sapiens; identical to SEQ ID NO: 539069
  misc_feature: HIJSMM301DMKAP.48.26.C04.1.454.light.4.raw

SEQ ID NO: 556773 - DNA, 481 bp, Homo sapiens
  misc_feature: HIJSMM301AK822.40.59.F04.1.454.light.4.raw
tctagcgactcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggtcggagggaccaagctgaccgtcctaagtcagaccccg

SEQ ID NO: 556774 - DNA, 516 bp, Homo sapiens
  misc_feature: HIJSMM301DYBQ0.14.66.F11.1.454.light.4.raw
cgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatgccaaggagacggcctcggaagctattatgcaagctggtaccagcagaagccaggacaggcccctgtacttgtcatctatggtaaaacatccggccctcagggatcccagaccgattctctggctccaactcaggaaacacagcttccttgaccatcactggggctcaggcggaagatgaggctgactattactgtaattcccgggacagcagtgctaaccccaattatgtcttcggaactgggaccaaggtcaccgtcctaggtcagcccaaggccaacccta

SEQ ID NO: 556775 - DNA, 505 bp, Homo sapiens; identical to SEQ ID NO: 535503
  misc_feature: HIJSMM301CH56X.8.28.C06.1.454.light.4.raw

SEQ ID NO: 556776 - DNA, 474 bp, Homo sapiens
  misc_feature: HIJSMM301BTP2H.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcactttcgcctgggactgaagtgcatatgaagagaactgtggctgca

SEQ ID NO: 556777 - DNA, 494 bp, Homo sapiens; identical to SEQ ID NO: 535680
  misc_feature: HIJSMM301D6B3S.16.78.H01.1.454.light.4.raw

SEQ ID NO: 556778 - DNA, 477 bp, Homo sapiens
  misc_feature: HIJSMM301A86UB.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttacctcgacgtcgtccagggacgacgtggatgtcagcgaactagtggctgcaccat

SEQ ID NO: 556779 - DNA, 484 bp, Homo sapiens; identical to SEQ ID NO: 535240
  misc_feature: HIJSMM301C46U6.47.60.F05.1.454.light.4.raw

SEQ ID NO: 556780 - DNA, 489 bp, Homo sapiens; identical to SEQ ID NO: 535139
  misc_feature: HIJSMM301DU11A.14.55.E11.1.454.light.4.raw

SEQ ID NO: 556781 - DNA, 481 bp, Homo sapiens
  misc_feature: HIJSMM301C8NRQ.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaaacctgcacccctgaagatgttggaagttattactgtcagacctatagtggtggcccgctcattttcggcggagggaccaaggtgcagatcaaacgaactgtgg

SEQ ID NO: 556782 - DNA, 487 bp, Homo sapiens
  misc_feature: HIJSMM301AZPVZ.4.40.D07.1.454.light.4.raw
agcactgtagcacgaccggtgctcgatttagtgatagagcgtaacaacagagggggagctgctcagttaggacccagaggcaaccatggaaaccccagcgcagcttctcttcctcctgctactctggctcccagataccacaggagaagttgtgttgacgcagtctccaggcaccctgtctttgtctccaggggagagggccaccctctcctgcaggaccagtcagagtgataccaacaactttttagcctggtaccaacagaaagctggccaggctcccaggctcctcatctatggtgcatccatcagggccactggcatcccagacaggttcagtggcagtgggtctgggacagacttcactctcatcatcaacagactggagcctgaggattctgcagtgtattactgtcaccagtatggtgggcgcgcgttttcggcgggggaccgaaggtggacgatcaaacgaactgtggctgcaccatct

SEQ ID NO: 556783 - DNA, 485 bp, Homo sapiens
  misc_feature: HIJSMM301AFPQR.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggtcggagggaccgaaggtggagatcaacgaa

SEQ ID NO: 556784 - DNA, 491 bp, Homo sapiens
  misc_feature: HIJSMM301BZZWN.41.23.C01.1.454.light.4.raw
tctatactatcacgaccggtgctcgatttagtacacgtgattagggattgggggcaggagtcagacccagtcaggacacagcatggacatgagggtccccgctcagctcctggggctcctgctgctctggttcccaggttcccgatgcggcatccagatgacccagtctccatctttcgtgtctgcatctataggagacagagtcaccatcacttgtcgggcgagtcaggatattaggacgtggttagcctggtatcgacagagaccgggaagagcccctgaactcctcgtctatgatgcatccactttacatcgtggggtcccatcacggttcagcggcagtggatctgggacagacttcagtctcaccatcagtaccctgcagcctgacgattttgcaatttattttgtcaacaggctaataggttccctcaaacattcggccctgggaccagagtggatttgaagcgaactgtggctgcaccatctgt

SEQ ID NO: 556785 - DNA, 487 bp, Homo sapiens; identical to SEQ ID NO: 536536
  misc_feature: HIJSMM301BHAKF.26.45.E01.1.454.light.4.raw

SEQ ID NO: 556786 - DNA, 489 bp, Homo sapiens
  misc_feature: HIJSMM301BCKNK.49.38.D05.1.454.light.4.raw
agtcgagagacacgaccggtgctcgatttagtatctgatagttgggtttgggggctgtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagacaaattgggggataaatatgctggctggtatcagcagaggccaggccagtcccctgtgttggtcatctatcaagataccaagcggccctcagggatccctgagcgattctctggctccaactctgggaacacagccactctgaccatcagcgggactcaggctatcgatgaggctgactattactgtcaggcgtgggacagccgcactggggtattcggcggagggaccaagctgaccgtcctgagtcagcccaaggctgccccccg

SEQ ID NO: 556787 - DNA, 473 bp, Homo sapiens
  misc_feature: HIJSMM301CBY65.15.8.A08.1.454.light.4.raw
tctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtatcccagccaggttcagtggcagtgggtctggcacagagttcactctcaccatcagcagcccgcagtctgaagtattttgcagtttattactgtcagcaatataacaagtggccattcactttcggcccagggaccaaagtggatatcaaacgaactgtggctgcaccatctgtcttcatcttcccgccat

SEQ ID NO: 556788 - DNA, 480 bp, Homo sapiens
  misc_feature: HIJSMM301AKG80.13.73.G07.1.454.light.4.raw
tcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatcagcagggtggaggctgaggatgttattggggctctattattgcatgcaagcaacacactggccgtacacttttggccaggggaccaagctggagatcaatcgaa

SEQ ID NO: 556789 - DNA, 506 bp, Homo sapiens
  misc_feature: HIJSMM301DVMM1.16.46.E02.1.454.light.4.raw
tgtactactccacgaccggtgctcgatttagactcatctacagggaaaggggggatctcaggaggcagctctctcggaatatctccaccatggcctgggctctgctcctcctcaccctcctcactcagggcacaggatcctgggctcagtctgccctgactcagcctccctccgtgtccgagtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaacccactcgtcact

SEQ ID NO: 556790 - DNA, 447 bp, Homo sapiens; identical to SEQ ID NO: 535201
  misc_feature: HIJSMM301BK02V.18.9.A09.1.454.light.4.raw

SEQ ID NO: 556791 - DNA, 446 bp, Homo sapiens
  misc_feature: HIJSMM301BB2SS.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctcgccccctcggtcactctcgttcccgccctcctccgtgtctgat

SEQ ID NO: 556792 - DNA, 483 bp, Homo sapiens
  misc_feature: HIJSMM301BUDD3.14.53.E09.1.454.light.4.raw
cgtctagtaccacgaccggtgctcgatttagagagagtgtgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgctttttggaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttatcgggtgttcggcggagggaccaagctgaccgtcctaggtcagccaaggctgccccctcggtcta

SEQ ID NO: 556793 - DNA, 520 bp, Homo sapiens; identical to SEQ ID NO: 540293
  misc_feature: HIJSMM301AUD2M.27.23.C01.1.454.light.4.raw

SEQ ID NO: 556794 - DNA, 512 bp, Homo sapiens
  misc_feature: HIJSMM301E03DO.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccgcctcct

SEQ ID NO: 556795 - DNA, 489 bp, Homo sapiens
  misc_feature: HIJSMM301BF22Y.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaggcggagatcaagacgaactgtggctgcaccatctgtcttcta

SEQ ID NO: 556796 - DNA, 485 bp, Homo sapiens; identical to SEQ ID NO: 535501
  misc_feature: HIJSMM301C97X7.3.10.A10.1.454.light.4.raw

SEQ ID NO: 556797 - DNA, 486 bp, Homo sapiens
  misc_feature: HIJSMM301CXQM6.10.1.A01.1.454.light.4.raw
catagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagggacagaccgccacactcacctgcactgggaacaacaacaatgttggccacgacggagtcgtttggctgcagcagcaccagggccaccctcccaagctcctctccgacaggaataacatccggccctcagggatctcagagagattctctgcatccaggtcaggaagcacagcctccctgaccattactggactccaggctgacgacgaagctgattattactgctcagcatgggacaccggcctcagtgcgtgggttttcggcggagggaccaagctgaccgtcctaggtcagccccg

SEQ ID NO: 556798 - DNA, 497 bp, Homo sapiens; identical to SEQ ID NO: 534982
  misc_feature: HIJSMM301EQIIN.26.80.H03.1.454.light.4.raw

SEQ ID NO: 556799 - DNA, 483 bp, Homo sapiens
  misc_feature: HIJSMM301DDAQF.52.22.B11.1.454.light.4.raw
cgcagtacgacacgaccggtgctcgatttagacgacagctcaggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcatttgccgggcaagtcagagtattagcagctatttaaattggtatcaacataccccggggaaggcccctaagttactgatctatgctgcagccaatttgcaaagtggggtcccatcaaggttcagtggcagtggatctgggacagaattcactctcaccatcagcagtctgcaacctgaagattttggaaagtactattgtcaacagagttacggaaacttgctcattttcggcggagggaccaaggtggagatcaaacgaactgtggctgcaccatctgtcttcatt

SEQ ID NO: 556800 - DNA, 483 bp, Homo sapiens
  misc_feature: HIJSMM301CEV27.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtggtccgctcattttcggcggagggaccaaggtgcagatcaaacgactgtggctgca

SEQ ID NO: 556801 - DNA, 484 bp, Homo sapiens; identical to SEQ ID NO: 537891
  misc_feature: HIJSMM301A1ZMG.10.1.A01.1.454.light.4.raw

SEQ ID NO: 556802 - DNA, 480 bp, Homo sapiens; identical to SEQ ID NO: 546518
  misc_feature: HIJSMM301CK8QR.4.39.D06.1.454.light.4.raw

SEQ ID NO: 556803 - DNA, 501 bp, Homo sapiens
  misc_feature: HIJSMM301A7ET3.43.37.D04.1.454.light.4.raw
tgtgagtagtcacgaccggtgctcgatttagtagcatactgttgggtttggggagcttcagctgtgggtagagaagacaggactcaggacaatctccagcatggccagcttccctctcctcctcaccctcctcactcactgtgcagggtcctgggcccagtctgtggtgactcagccaccctcagcgtctgggacccccggacagagggtcagcatctcctgttctggaagcagctccaacattggacgtaatactgtaaactggtaccagcaactcgcaggaacggcccccaaactcctcatctatgaccatcatcagcggccctcaggggtccctgaccgattctctggctccaagtctggctcttcagcctccctggccatcagtgggctccagtctgaggatgaggctgattattactgtgcagcgtgggatgacagcctgaatgcttgggtgttcggcggagggaccaagggtgaccgtcctagggtcagaccccg

SEQ ID NO: 556804 - DNA, 472 bp, Homo sapiens; identical to SEQ ID NO: 535898
  misc_feature: HIJSMM301BIYES.15.8.A08.1.454.light.4.raw

SEQ ID NO: 556805 - DNA, 521 bp, Homo sapiens
  misc_feature: HIJSMM301DIIFD.27.23.C01.1.454.light.4.raw
agcgtcgtctcacgaccggtgctcgatttagtacacgtgattagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccacct

SEQ ID NO: 556806 - DNA, 491 bp, Homo sapiens; identical to SEQ ID NO: 548535
  misc_feature: HIJSMM301EBJ7N.51.71.G05.1.454.light.4.raw

SEQ ID NO: 556807 - DNA, 494 bp, Homo sapiens
  misc_feature: HIJSMM301DRSNR.22.86.H09.1.454.light.4.raw
acatacgcgtcacgaccggtgctcgatttagtgctatagacttgggtttgggaggagagaccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctcctgaccatctctgggctccaggctgaagatgaggctgattattactgctgctcatttgcaggcgcctacacttgggtgttcggcggagggccaagctgaccgtcctaggtcagcccaaggctgccccctggtccactctgttcccaccctcctc

SEQ ID NO: 556808 - DNA, 483 bp, Homo sapiens; identical to SEQ ID NO: 535413
  misc_feature: HIJSMM301CNHEO.26.78.H01.1.454.light.4.raw

SEQ ID NO: 556809 - DNA, 500 bp, Homo sapiens
  misc_feature: HIJSMM301BSZLX.2.49.E05.1.454.light.4.raw
acgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtaccccgggcagagggtcaccatctcttgttctggaagcatgtccaacatcggaagtgataatgtatactggtaccagcagttcccaagagcggcccccaagctcctcatctatagaaattatgaacggtcctcaggggtccctgaccgattctctggctccaagtctggcacctcagcctccctggccatcagtgggctccggtccgaggatgaggctgattattactgtgttggatgggacagcagcctgagtgcttatgtcttcggaactgggaccacggtcaccgtcctaggt

SEQ ID NO: 556810 - DNA, 511 bp, Homo sapiens; identical to SEQ ID NO: 541720
  misc_feature: HIJSMM301AVC38.5.58.F03.1.454.light.4.raw

SEQ ID NO: 556811 - DNA, 489 bp, Homo sapiens
  misc_feature: HIJSMM301EV5SQ.40.17.B06.1.454.light.4.raw
tctagcgactcacgaccggtgctcgatttagtcgatagtgaagggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggaccttcggtccagggaccagggtggaaagtcaaacgaactagtggctgcaccatctgtcttcta

SEQ ID NO: 556812 - DNA, 503 bp, Homo sapiens
  misc_feature: HIJSMM301B4VC4.52.36.D03.1.454.light.4.raw
cgcagtacgacacgaccggtgctcgatttagctgcgtcacgatctctcttgggggtgggctcaggaggcagagctgtgggtgtctcaccatggcgtgggccacactcctgctcccactcctcaacctctacgcaggctctgttgcctcctatgagctgacacagcttccctcggtgtcagtgtccccaggacagacagccaggatcacctgctctggagatgtactggggaaaaattatgctgactggtaccagcagaagccaggccaagcccctgagttggtgatatacgaaaatagtgagcgctaccctgggatccctgaccgattctctgggtccacctcagggaagacgaccaccctgaccatcaacagggtccggactgaagacgaggctgactattactgcttgtctggggatgaggacacattggtgttcggcggagggaccaagctgaccgtctacgtcagcccaaggctgccccctcggtcactctgttccccg

SEQ ID NO: 556813 - DNA, 380 bp, Homo sapiens
  misc_feature: HIJSMM301EIHE2.47.14.B03.1.454.light.4.raw
agctcacgtacacgaccggtgctcgatttagtgtgagtagtttgagtttgggggccgttccggggagcagctccaacatcggaaggaatgatgtgtactggttgcagcaactccccggaacggcccccaaactcctcatctatacgaataatcagcggtcctcaggggtccctgaccgattctctggctccaagtctgacacctcagcctccctggccatcagtgggctccggtccgaggatgaggctgattattattgtgcaacatgggatagtagcctgagtagtgtggttttcggcggagggaccaaactgaccgtcctaggtcagcccaaggctgccccctcggtcactctgttcccaccctcctctacgtgagct

SEQ ID NO: 556814 - DNA, 495 bp, Homo sapiens
  misc_feature: HIJSMM301E2G5N.48.1.A01.1.454.light.4.raw
agtatacatacacgaccggtgctcgatttagacgtctcatcagggggcaggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaattttcgctgtctccagtttgcagagtggagtcccatctcggttcagcggcagtggatctggggcagagttcattctcaccatcaacagccttcagcctgaagattttgcaacttactattgtcagcagggtgacagtttccctcccactttcggcggagggaccgagggtggacgtcaaacgaacctagtggctgcaccatctgtcttcatt

SEQ ID NO: 556815 - DNA, 474 bp, Homo sapiens; identical to SEQ ID NO: 537034
  misc_feature: HIJSMM301EXTXB.5.15.B04.1.454.light.4.raw

SEQ ID NO: 556816 - DNA, 485 bp, Homo sapiens
  misc_feature: HIJSMM301DMX01.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttatctccagcgttcggccagggaccaaggtggaagtcaagcgaactgtggctgcacatctgt

SEQ ID NO: 556817 - DNA, 444 bp, Homo sapiens; identical to SEQ ID NO: 535856
  misc_feature: HIJSMM301EM9L2.9.9.A09.1.454.light.4.raw

SEQ ID NO: 556818 - DNA, 493 bp, Homo sapiens; identical to SEQ ID NO: 535657
  misc_feature: HIJSMM301B0S7V.27.78.H01.1.454.light.4.raw

SEQ ID NO: 556819 - DNA, 506 bp, Homo sapiens; identical to SEQ ID NO: 543993
  misc_feature: HIJSMM301A3WGX.18.78.H01.1.454.light.4.raw

SEQ ID NO: 556820 - DNA, 498 bp, Homo sapiens
  misc_feature: HIJSMM301A6SRZ.22.86.H09.1.454.light.4.raw
  modified_base (489)..(489): a, c, t, g, unknown or other
acatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgaccgtcctaggtcagcccaaggctgccccctcggtcactctgttcccnccctcctcc

SEQ ID NO: 556821 - DNA, 485 bp, Homo sapiens
  misc_feature: HIJSMM301CSMAN.48.10.A10.1.454.light.4.raw
agtatacatacacgaccggtgctcgatttagcgtcgatctcaggggggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggaccttcggccaaggaccaggtggaaagtcaaacgaactagtggctgcaccatctgtctt

SEQ ID NO: 556822 - DNA, 497 bp, Homo sapiens
  misc_feature: HIJSMM301CYAYD.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgccccccgactcaccttcggtccgaacggacgacgactggagattaaacgaaactgtggcgtgcaccactctgtcttctat

SEQ ID NO: 556823 - DNA, 496 bp, Homo sapiens
  misc_feature: HIJSMM301BCCE7.41.18.B07.1.454.light.4.raw
tctatactatcacgaccggtgctcgatttagtcgctgcgtaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccgaagctgaccgtcctaggtcagcccaaggctgcccctcggtcactctgtt

SEQ ID NO: 556824 - DNA, 514 bp, Homo sapiens
  misc_feature: HIJSMM301CFJ7Y.7.5.A05.1.454.light.4.raw
cgtgtctctacacgaccggtgctcgatttagatagatagacagggggggtcgtcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcaggggtttccaatcgcttctctggctcaagtctggcgacacggcctccctgaccatctctgggctccaggctgaagacgaggctgattattactgcagctcatatacaggcagcagcactcaggttttcggtccggaggggaccgaacgcgtgaacccggtccttaggtccaggccccaaggccttcggcccccctcggt

SEQ ID NO: 556825 - DNA, 383 bp, Homo sapiens; identical to SEQ ID NO: 447524
  misc_feature: HIJSMM301E0BLQ.41.26.C04.1.454.light.4.raw

SEQ ID NO: 556826 - DNA, 473 bp, Homo sapiens
  misc_feature: HIJSMM301C8BQF.15.8.A08.1.454.light.4.raw
tctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtatcccagccaggttcagtggcagtgggtctggcacagagttcactctcaccatcagcagcccgcagtctgaagattttgctagtttattactgtcagcaatataacaagtggccattcactttcggcccagggaccaaagtggatatcaaacgaactgtggctgcaccatctgtcttcatcttcccgccat

SEQ ID NO: 556827 - DNA, 489 bp, Homo sapiens
  misc_feature: HIJSMM301EE7Q6.49.73.G07.1.454.light.4.raw
agtcgagagacacgaccggtgctcgatttagctctacgctcagggcacgaccggtgctcgatttagatcacgtgcgtcgcgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagaatattaataagtggttggcctggtatcagcagataccagggaaagcccctaaactcctgatctatgaggcgtctagtttagaaagtggggtcccttcaaggttcagcggcagtggatctgggacagaattcactctcaccatcaacagcctgcagcctgatgattttgcaacttattactgccaacactataatcattattctccggccactttcggccctgggaccaggct

SEQ ID NO: 556828 - DNA, 520 bp, Homo sapiens; identical to SEQ ID NO: 537173
  misc_feature: HIJSMM301DZNCF.27.23.C01.1.454.light.4.raw

SEQ ID NO: 556829 - DNA, 494 bp, Homo sapiens; identical to SEQ ID NO: 536444
  misc_feature: HIJSMM301EQPNK.26.72.G06.1.454.light.4.raw

SEQ ID NO: 556830 - DNA, 497 bp, Homo sapiens; identical to SEQ ID NO: 535286
  misc_feature: HIJSMM301D8M9M.18.59.F04.1.454.light.4.raw

SEQ ID NO: 556831 - DNA, 502 bp, Homo sapiens; identical to SEQ ID NO: 549179
  misc_feature: HIJSMM301BGP0A.14.57.F02.1.454.light.4.raw

SEQ ID NO: 556832 - DNA, 482 bp, Homo sapiens; identical to SEQ ID NO: 535352
  misc_feature: HIJSMM301D6LA0.16.81.H04.1.454.light.4.raw

SEQ ID NO: 556833 - DNA, 495 bp, Homo sapiens; identical to SEQ ID NO: 545183
  misc_feature: HIJSMM301CR4H1.16.10.A10.1.454.light.4.raw

SEQ ID NO: 556834 - DNA, 493 bp, Homo sapiens
  misc_feature: HIJSMM301BKIDD.48.4.A04.1.454.light.4.raw
agtatacatacacgaccggtgctcgatttagagtagtgatcaggggagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggaccttcggtccaagggaccgagggtgggaaagtactaaacgaaactgttggctgcaccaatctgtcttctatt

SEQ ID NO: 556835 - DNA, 491 bp, Homo sapiens; identical to SEQ ID NO: 544714
  misc_feature: HIJSMM301D9KE6.18.11.A11.1.454.light.4.raw

SEQ ID NO: 556836 - DNA, 354 bp, Homo sapiens; identical to SEQ ID NO: 535026
  misc_feature: HIJSMM301D4ZGX.19.22.B11.1.454.light.4.raw

SEQ ID NO: 556837 - DNA, 471 bp, Homo sapiens; identical to SEQ ID NO: 539388
  misc_feature: HIJSMM301DQFNS.13.39.D06.1.454.light.4.raw

SEQ ID NO: 556838 - DNA, 504 bp, Homo sapiens; identical to SEQ ID NO: 538423
  misc_feature: HIJSMM301ERMDE.48.67.G01.1.454.light.4.raw

SEQ ID NO: 556839 - DNA, 474 bp, Homo sapiens
  misc_feature: HIJSMM301DMX8O.13.4.A04.1.454.light.4.raw
tcacgtactacacgaccggtgctcgatttagagtagtgatcagggggagtcagtcccaaccaggacacagcatggacatgagggtccctgctcagctcctgggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacaggggtcccatcaaggttcagtggaagtggatctgggacagattttactttcaccatcagcagcctgcagcctgaagatattgcaacatattactgtcagcagtatgataatctcccgatcaccttcggccaagggacacgactggagattaaacgaactgtggctgcacc

SEQ ID NO: 556840 - DNA, 501 bp, Homo sapiens
  misc_feature: HIJSMM301BNPWZ.19.78.H01.1.454.light.4.raw
  modified_base (247)..(247): a, c, t, g, unknown or other
tactctcgtgcacgaccggtgctcgatttagtgtgagtagtttgggtttgggggctttatttgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaaggtaaancccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccactgtcactctgttcccaccctcctccacgagagta

SEQ ID NO: 556841 - DNA, 484 bp, Homo sapiens; identical to SEQ ID NO: 535240
  misc_feature: HIJSMM301C23U3.47.60.F05.1.454.light.4.raw

SEQ ID NO: 556842 - DNA, 484 bp, Homo sapiens
  misc_feature: HIJSMM301BAHOY.26.70.G04.1.454.light.4.raw
agactatactcacgaccggtgctcgatttagtgtagtgtgaagggaaagggggcaggaatcagacccagtcaggacacagcatggacatgagagtcctcgctcagctcctggggctcctgctgctctgtttcccaggtgccagatgtgacatccagatgacccagtcgccatcctcactgtctgcctctgtaggagacagagtcaccatcacttgtcgggcgagtcagggcattagcgattttttagcctggtttcagcagaaaccagggaaagcccccaagtccctgatctatgctgcgtccactttagaaggtggagtcccatcaaggttcagcggcagtggatctgggacagagttcactctcaacatcagcagcctgcagcctgaggattttgcaacttattactgccagcagtataatgattaccctatcaccttcggccgggggacacggctggaaactaacgaactgtggctgcacc

SEQ ID NO: 556843 - DNA, 449 bp, Homo sapiens
  misc_feature: HIJSMM301BYJ3N.18.9.A09.1.454.light.4.raw
  modified_base (430)..(430): a, c, t, g, unknown or other
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctcgttcccnccctcctccactactcgta

SEQ ID NO: 556844 - DNA, 462 bp, Homo sapiens
  misc_feature: HIJSMM301C27HO.40.2.A02.1.454.light.4.raw
tctagcgactcacgaccggtgctcgatttagactcatctacagggggagtcagacccactcaggacacagcatggacatgagggtccccgctcagctcctggggctcctgctgctctggctcccaggcgccagatgtgccatccagatgacccagtctccatcctcactgtctgcatctgtaggagacagagtcaccatcacttgccgggcaagtcagggcattggaaatgatttagcctggtatcagcagaaaccaggaaaagcccctcagctcctgatctatactgcatccactttacaaagtggagtcccatcaaggttcagcggcagtggatctggcacagatttcactctcaccatcagcagcctgcagcctgaagattttgcaacttattactgtctacaagattacaattaccctcggacttttggccaggggacctggctggagatcaaacgaa

SEQ ID NO: 556845 - DNA, 487 bp, Homo sapiens; identical to SEQ ID NO: 539157
  misc_feature: HIJSMM301ELLPY.26.37.D04.1.454.light.4.raw

SEQ ID NO: 556846 - DNA, 447 bp, Homo sapiens
  misc_feature: HIJSMM301A5VEZ.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactagtaccagcagcttccagggacagcccccaaactcctcatctttggtaacaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccaccctcctccatactcgta

SEQ ID NO: 556847 - DNA, 489 bp, Homo sapiens; identical to SEQ ID NO: 535091
  misc_feature: HIJSMM301CXVLQ.47.36.D03.1.454.light.4.raw

SEQ ID NO: 556848 - DNA, 484 bp, Homo sapiens; identical to SEQ ID NO: 535400
  misc_feature: HIJSMM301C8HM8.46.26.C04.1.454.light.4.raw

SEQ ID NO: 556849 - DNA, 486 bp, Homo sapiens
  misc_feature: HIJSMM301BZL6E.46.26.C04.1.454.light.4.raw
  modified_base (411)..(411): a, c, t, g, unknown or other
  modified_base (444)..(444): a, c, t, g, unknown or other
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctattgggttctaatcgggcctccggggtccctgacaggttcagtggcagtggatcatgcacagattttacactgaaaatcagcagagtggaggctgaggatgttgggntctattattgcatgcaagctctacaagtcccgntcactttcggcggagggacccaaggtgaggatcaaacgaacg

SEQ ID NO: 556850 - DNA, 444 bp, Homo sapiens; identical to SEQ ID NO: 536096
  misc_feature: HIJSMM301DDNBD.7.18.B07.1.454.light.4.raw

SEQ ID NO: 556851 - DNA, 493 bp, Homo sapiens
  misc_feature: HIJSMM301B6IU3.52.10.A10.1.454.light.4.raw
cgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctcttacctggcctggtaccaacaaaacctgcccaggctcccaggctcctcatctatgatgcatccaatcgggccactggcatcccagccaggttcagtggcagtgggtctgggacagacttcactctcaccatcagcaacctagagcctgaagactttgcagtttattactgtcagcagcgtagtaagtggcgcttcggccaagggacacgactggaggttaaacgaactgtggctgcaccatctgtcttcatcttcccgccat

SEQ ID NO: 556852 - DNA, 466 bp, Homo sapiens
  misc_feature: HIJSMM301DMH4R.48.2.A02.1.454.light.4.raw
agtatacatacacgaccggtgctcgatttagactcatctacagggggcaggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagcggcagtggatctggcacagagttcactctcaccatcagcaccctgcagcctgaagattttgcgacttatttctgtctacaagattctaattaccctcggacgctcggccaggggaccaaagtggatgtcaaccgaa

SEQ ID NO: 556853 - DNA, 521 bp, Homo sapiens
  misc_feature: HIJSMM301AP71E.40.42.D09.1.454.light.4.raw
tctagcgactcacgaccggtgctcgatttagacacatacgcagggaaaggggggccgtaaggaagcagcactggtggtgcctcagccatggcctggaccgttctcctcctcggcctcctctctcactgcacagggtctgtgacctcctatgtgctgactcagccactctcggtgtctgtggccccaggacaggcggccaatgttacctgtgggggaggacaacattgggagtaaaagtgtgcactggtaccagctgaagccaggccaggcccctgtgttggtcgtctttggacatggtgcccgaccctcggggatccctgagcgattctctgcctccaggtctgggaacacggccaccctgaccatcaccagggtcgaggccggagatgaggccgactatttttgtcacgtgtggcacgttagtcatcacgtcttcggaactgggaccacggtcaccgtcctaagtcagcccaaggccaaccccactgtcacctctgttcccaccctcctcagtcgctaga

SEQ ID NO: 556854 - DNA, 485 bp, Homo sapiens; identical to SEQ ID NO: 538533
  misc_feature: HIJSMM301DEJRC.47.78.H01.1.454.light.4.raw

SEQ ID NO: 556855 - DNA, 508 bp, Homo sapiens
  misc_feature: HIJSMM301E06U8.41.18.B07.1.454.light.4.raw
tctatactatcacgaccggtgctcgatttagtcgctgcgtaaggggggtggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtggttcggcggggggaccgaaggctgaccgtcctaggtcagcccaacggctgccccctccggtccactccttcg

SEQ ID NO: 556856 - DNA, 483 bp, Homo sapiens
  misc_feature: HIJSMM301D24Z9.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttcggccagggaccaaggtggaatacaaacgaactagtggctgcacca

SEQ ID NO: 556857 - DNA, 494 bp, Homo sapiens; identical to SEQ ID NO: 534992
  misc_feature: HIJSMM301BQH6M.9.1.A01.1.454.light.4.raw

SEQ ID NO: 556858 - DNA, 520 bp, Homo sapiens; identical to SEQ ID NO: 535773
  misc_feature: HIJSMM301APR5U.41.19.B08.1.454.light.4.raw

SEQ ID NO: 556859 - DNA, 487 bp, Homo sapiens; identical to SEQ ID NO: 535583
  misc_feature: HIJSMM301BSOL7.22.73.G07.1.454.light.4.raw

SEQ ID NO: 556860 - DNA, 503 bp, Homo sapiens; identical to SEQ ID NO: 538583
  misc_feature: HIJSMM301EZIRN.15.59.F04.1.454.light.4.raw

SEQ ID NO: 556861 - DNA, 487 bp, Homo sapiens
  misc_feature: HIJSMM301CQ2CA.49.81.H04.1.454.light.4.raw
agtcgagagacacgaccggtgctcgatttagtagtgtagattcgcgggcgtagactttgtgtttctcgtagtctccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacggtgcatccaatttggaaataggggtcccatcaaggttcagtggaagtggatctgggacgtattttactttcaccatcatcaacctgcagcctgaggatattgcaacatattactgtcaacaatatgataatctaccactcactttcggcggagggaccacggtggagatcaaacgaactgtggctgcaccatctgtcttcatcttcccgccat

SEQ ID NO: 556862 - DNA, 490 bp, Homo sapiens
  misc_feature: HIJSMM301CZ61R.51.39.D06.1.454.light.4.raw
cgatcgtatacacgaccggtgctcgatttagtgacatctcgcagttctttgggggggagcctagctgtgctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccaacagaagccaggccaggcccctgtgttgttgatatataaagacagtgagaggccttcagggatccctgagcgattctctggctccacctcagggacactggtcacattgaccatcagtggagtccaggcagaagacgaggctgactatttctgtcaatcttcagacgtcagtggtacttatgtcttcggaactgggaccaaggtcaccgtcctaggtcag

SEQ ID NO: 556863 - DNA, 486 bp, Homo sapiens; identical to SEQ ID NO: 535385
  misc_feature: HIJSMM301CKIXN.19.71.G05.1.454.light.4.raw

SEQ ID NO: 556864 - DNA, 496 bp, Homo sapiens
  misc_feature: HIJSMM301APVVX.51.30.C08.1.454.light.4.raw
cgatcgtatacacgaccggtgctcgatttagtctgacgtcaaagggaaagggggaggaactgctcagtcaggacccagacggaaccatggaagccccagcgcagcttctcttcctcctgctactctggctcccagatactactggagaaatagtgatgacgcagtctccagccacgctgtctgtgtctccaggggaaagagccaccctctcctgcagggccagtcagagtgttaacaacaacttagcctggtatcagcagaaacctggccaggctcccaggctcctcatctttggatcatccatcagggccactggtgtcccagaaaagttcagtggcggtgggtctgacacagagtacaccctcaccatcagcaccctgcagtctgaagatgtcgcagtttattactgtcaacaatatagtgacaggccgccatggacgttcggccaagggaccaaggtggaaatgaaaggaactgtggctgcaccatctgtctt

SEQ ID NO: 556865 - DNA, 489 bp, Homo sapiens; identical to SEQ ID NO: 535386
  misc_feature: HIJSMM301EVAU7.12.51.E07.1.454.light.4.raw

SEQ ID NO: 556866 - DNA, 495 bp, Homo sapiens; identical to SEQ ID NO: 535821
  misc_feature: HIJSMM301EONLK.3.31.C09.1.454.light.4.raw

SEQ ID NO: 556867 - DNA, 489 bp, Homo sapiens
  misc_feature: HIJSMM301COVH5.51.35.D02.1.454.light.4.raw
cgatcgtatacacgaccggtgctcgatttagcacacgatagttgggtttggggctggggagcctagctgtgctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggt

SEQ ID NO: 556868 - DNA, 504 bp, Homo sapiens
  misc_feature: HIJSMM301D5UQR.12.53.E09.1.454.light.4.raw
atacgacgtacacgaccggtgctcgatttagagagagtgtgttgggtttggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaagctgaccgtcctgggtcagcccaaggctgcccctcggtcactctgttcccaccctcctcctacgtcgtat

SEQ ID NO: 556869 - DNA, 501 bp, Homo sapiens
  misc_feature: HIJSMM301BUDVH.21.81.H04.1.454.light.4.raw
tcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacgaggctgattattactgcaggtcatatacaatcagcaacacttatgtcttcgggactgggaccaagatcaccgtcctaggtcagcccaaggccaaccccactgtca

SEQ ID NO: 556870 - DNA, 495 bp, Homo sapiens; identical to SEQ ID NO: 549785
  misc_feature: HIJSMM301D1BPB.12.38.D05.1.454.light.4.raw

SEQ ID NO: 556871 - DNA, 475 bp, Homo sapiens; identical to SEQ ID NO: 551399
  misc_feature: HIJSMM301DN2HN.4.79.H02.1.454.light.4.raw

SEQ ID NO: 556872 - DNA, 486 bp, Homo sapiens; identical to SEQ ID NO: 535290
  misc_feature: HIJSMM301D0E4R.3.12.B01.1.454.light.4.raw

SEQ ID NO: 556873 - DNA, 444 bp, Homo sapiens; identical to SEQ ID NO: 535192
  misc_feature: HIJSMM301DG2JT.5.9.A09.1.454.light.4.raw

SEQ ID NO: 556874 - DNA, 490 bp, Homo sapiens
  misc_feature: HIJSMM301ED137.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccgaacgggaccaaggtggagtatacagacgaa

SEQ ID NO: 556875 - DNA, 503 bp, Homo sapiens
  misc_feature: HIJSMM301DQJBA.9.53.E09.1.454.light.4.raw
tgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcgagggaccaaggtgaccgtcctaggtcagcccaaggctgccccccg

SEQ ID NO: 556876 - DNA, 504 bp, Homo sapiens
  misc_feature: HIJSMM301BSKRP.40.67.G01.1.454.light.4.raw
tctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccagggccactggcgtcccggccaggttcagtggcagtgggtctgggacagccttcactctcaccatcagcagcctggagcccgaagattttgcggtttattactgtcagcagcgtgccgactggcccctcacgttcggcggagggaccaaggtggacatcaaacgaactgtggctgcaccatctgtcttcatcttcccgc

SEQ ID NO: 556877 - DNA, 483 bp, Homo sapiens
  misc_feature: HIJSMM301C04RV.5.23.C01.1.454.light.4.raw
atcagacacgcacgaccggtgctcgatttagtacacgtgattagggattgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtggggtcccatcaaggttcagtggcagtggatctgggacagatttcactctcaccatcaccagcctgcagcctgaagatcttgcaacttactattgtcagcaggctaggaggacgccgtggacgttcggccaagggaccaaggtggaaatcaaacgaactgtggctgcacca

SEQ ID NO: 556878 - DNA, 477 bp, Homo sapiens; identical to SEQ ID NO: 552384
  misc_feature: HIJSMM301CDJMD.16.86.H09.1.454.light.4.raw

SEQ ID NO: 556879 - DNA, 496 bp, Homo sapiens; identical to SEQ ID NO: 536248
  misc_feature: HIJSMM301CZYKL.22.27.C05.1.454.light.4.raw

SEQ ID NO: 556880 - DNA, 483 bp, Homo sapiens; identical to SEQ ID NO: 535013
  misc_feature: HIJSMM301CNQ8F.11.76.G10.1.454.light.4.raw

SEQ ID NO: 556881 - DNA, 478 bp, Homo sapiens; identical to SEQ ID NO: 545131
  misc_feature: HIJSMM301CCSHU.5.52.E08.1.454.light.4.raw

SEQ ID NO: 556882 - DNA, 486 bp, Homo sapiens; identical to SEQ ID NO: 535043
  misc_feature: HIJSMM301A9Y1X.46.35.D02.1.454.light.4.raw

SEQ ID NO: 556883 - DNA, 485 bp, Homo sapiens; identical to SEQ ID NO: 538954
  misc_feature: HIJSMM301CAGMO.3.55.E11.1.454.light.4.raw

SEQ ID NO: 556884 - DNA, 447 bp, Homo sapiens; identical to SEQ ID NO: 535020
  misc_feature: HIJSMM301DV749.18.9.A09.1.454.light.4.raw

SEQ ID NO: 556885 - DNA, 514 bp, Homo sapiens
  misc_feature: HIJSMM301C4ONT.47.53.E09.1.454.light.4.raw
  modified_base (507)..(507): a, c, t, g, unknown or other
agctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctctgggatccccgagcgattctctggctccaagtctgggaacacggccaccctgaccgtcagcagggtcgacgtcgggatgaggccgtatattttgtcaggtgtgggagactaatttggtcatatgttgttcggcggagggaccaagctgaccgtcctcggtcagcccaaggctgccccctcggtcactctgttcccnccctcct

SEQ ID NO: 556886 - DNA, 476 bp, Homo sapiens; identical to SEQ ID NO: 541471
  misc_feature: HIJSMM301B2V17.13.4.A04.1.454.light.4.raw

SEQ ID NO: 556887 - DNA, 481 bp, Homo sapiens
  misc_feature: HIJSMM301BZZN5.13.50.E06.1.454.light.4.raw
tcacgtactacacgaccggtgctcgatttagatctactgacaacacacaagggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggctcccaggctcctcatttatggtgcatccactagggccactggtgtcccagtcaggttcagcggcagtgggtctgggacagacttcactctcaccatcagcagcctgcagtctgaagatttgcagtctattactgtcagcagtatagttactggagaaccttcggccaagggacacgactggagattaaaggaactgtggctgcacc

SEQ ID NO: 556888 - DNA, 484 bp, Homo sapiens; identical to SEQ ID NO: 535400
  misc_feature: HIJSMM301DJ0J2.46.26.C04.1.454.light.4.raw

SEQ ID NO: 556889 - DNA, 509 bp, Homo sapiens; identical to SEQ ID NO: 535670
  misc_feature: HIJSMM301EQLEZ.47.23.C01.1.454.light.4.raw

SEQ ID NO: 556890 - DNA, 510 bp, Homo sapiens
  misc_feature: HIJSMM301BRSSD.40.47.E03.1.454.light.4.raw
tctagcgactcacgaccggtgctcgatttagactcgcgcacagagagaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcgccatctcctgcactggaaccaataatgacgttggtggttacaactatgtctcctggtaccaacaatacccaggcaaagcccccaaactcctgatttatgaggtcagtaagcggccctcaggggtccctgatcgcttctctggctccaagtctgtcaacacggcctccctgaccgtctctgggctccaggctgaggatgaggctgtttactactgcagctcatatgcaggcagcaataatttggtgttcggcgggggaccaagctgaccgtcctaggtcagcccaaggctcgccccctcggtcta

SEQ ID NO: 556891 - DNA, 463 bp, Homo sapiens
  misc_feature: HIJSMM301BPIQX.49.9.A09.1.454.light.4.raw
agtcgagagacacgaccggtgctcgatttagcgagacgcgcagggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcgtgtatctgaattggtatcagcaaaaaccagggaaagcccctgagctcctgatcctcgatgcatccaatttggaaacaggggtcccatcgaggttctctggaagtggctctgggacacattttactttcaccatcagcagactgcagcctgaagatattgcaacatattactgtcaacagtatgataatctcccgctcactttcggcggagggaccaaaggtggagatcaaacgaa

SEQ ID NO: 556892 - DNA, 509 bp, Homo sapiens; identical to SEQ ID NO: 548565
  misc_feature: HIJSMM301BH4KF.40.48.E04.1.454.light.4.raw

SEQ ID NO: 556893 - DNA, 496 bp, Homo sapiens
  misc_feature: HIJSMM301CCJN0.22.9.A09.1.454.light.4.raw
acatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcagtgggtctggaagagacttcactctcaccatcaacagcctagagcctgacgattctgccgtttattactgtcagcagcgtaccaagtggcctccgacttttggccagggggccaagctggagatcagacgaactgtggctgcaccatctgtcttcatcttcccg

SEQ ID NO: 556894 - DNA, 460 bp, Homo sapiens; identical to SEQ ID NO: 537107
  misc_feature: HIJSMM301EJT32.22.28.C06.1.454.light.4.raw

SEQ ID NO: 556895 - DNA, 510 bp, Homo sapiens
  misc_feature: HIJSMM301C4MW6.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaacccactgtcactctcgttcccta

SEQ ID NO: 556896 - DNA, 477 bp, Homo sapiens
  misc_feature: HIJSMM301E0222.13.11.A11.1.454.light.4.raw
tcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagcctacatcacctgctctggagataaattgggggataaatatgcttgctggtatcagcagaagccaggccagtcccctgtgctggtcatctatcaagataccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcaccgtcctaagtcagcccaagg

SEQ ID NO: 556897 - DNA, 496 bp, Homo sapiens; identical to SEQ ID NO: 537925
  misc_feature: HIJSMM301EXTT7.22.14.B03.1.454.light.4.raw

SEQ ID NO: 556898 - DNA, 472 bp, Homo sapiens
  misc_feature: HIJSMM301DEMKC.13.76.G10.1.454.light.4.raw
tcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcaccgtcctaagtcag

SEQ ID NO: 556899 - DNA, 484 bp, Homo sapiens; identical to SEQ ID NO: 535240
  misc_feature: HIJSMM301DF9K1.47.60.F05.1.454.light.4.raw

SEQ ID NO: 556900 - DNA, 503 bp, Homo sapiens
  misc_feature: HIJSMM301B3PLJ.22.46.E02.1.454.light.4.raw
acatacgcgtcacgaccggtgctcgatttagactcatctacagggaaaggggggggtctcaggaggtcagcactctcgggacgtctccaccatggcctgggctctgctcctcctcagcctcctcactcagggcacaggatcctgggctcagtctgccctgactcagcctcgctcagtgtccgggtctcctggacagtccgtcaccatctcctgcactgggaccagcagtgatgttggtgcttataactatgtctcctggtaccagcaccaccaggcaaagccccccaactcttaattttggtgtcaataaccgccctcagggtccctgatcgcttctccggctccaagtctggcaacacggcctccctgaccatctctggactccaggctgacgatgagggtgacttttactgctgctcatatgcaggcaactataatatggtcttcggcggagggaccaaagtgaccgtcctaggtcagcccaaggctgccccctggtcact

SEQ ID NO: 556901 - DNA, 488 bp, Homo sapiens
  misc_feature: HIJSMM301C4SG0.12.31.C09.1.454.light.4.raw
atacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctccctgtctgcatctgtaggagacaaagtcaccatcacttgccgggctaacgagagtattgccacgtatttaaattggtatcaacaaaaagcaggcaaagtcccaaagctcctgatttatgctgccaccagtctgcaaggtggttcccgtcaaggttcactggccgtggatcagggacagaatttactctcaccatcagtagtctacagcctgaagatattgctacttattactgtcagcagagttaccgcgctcccatccactttcggccaagggacacgaccgcagattggacgaactgtggctgcacc

SEQ ID NO: 556902 - DNA, 487 bp, Homo sapiens; identical to SEQ ID NO: 540621
  misc_feature: HIJSMM301DBVG1.46.35.D02.1.454.light.4.raw

SEQ ID NO: 556903 - DNA, 481 bp, Homo sapiens; identical to SEQ ID NO: 539712
  misc_feature: HIJSMM301B6IYR.51.60.F05.1.454.light.4.raw

SEQ ID NO: 556904 - DNA, 486 bp, Homo sapiens; identical to SEQ ID NO: 535043
  misc_feature: HIJSMM301ASVGN.46.35.D02.1.454.light.4.raw

SEQ ID NO: 556905 - DNA, 504 bp, Homo sapiens; identical to SEQ ID NO: 538521
  misc_feature: HIJSMM301DXDBE.9.12.B01.1.454.light.4.raw

SEQ ID NO: 556906 - DNA, 487 bp, Homo sapiens
  misc_feature: HIJSMM301DTLP0.26.23.C01.1.454.light.4.raw
  modified_base (484)..(484): a, c, t, g, unknown or other
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatattattctccagcttcggccaggggaccaaggtggaagtcaagcgaactgtggctgcaccatcngtt

SEQ ID NO: 556907 - DNA, 493 bp, Homo sapiens; identical to SEQ ID NO: 536296
  misc_feature: HIJSMM301CPGW5.5.48.E04.1.454.light.4.raw

SEQ ID NO: 556908 - DNA, 505 bp, Homo sapiens
  misc_feature: HIJSMM301DLZKD.48.73.G07.1.454.light.4.raw
agtatacatacacgaccggtgctcgatttagctctacgctcagggcacgaccggtgctcgatttagatcgtctgtgttgggtttggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaa

SEQ ID NO: 556909 - DNA, 493 bp, Homo sapiens
  misc_feature: HIJSMM301BO4QI.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctggggacagacttcactctcaccatcagcagactggagcctgaagattttgcagtctattactgtcagcagtatggtcacgtcccaagaacttttggccaggggaccaagctggagatacaaacgactagtggctgcaccatcttcg

SEQ ID NO: 556910 - DNA, 480 bp, Homo sapiens
  misc_feature: HIJSMM301CMJ8F.12.19.B08.1.454.light.4.raw
atacgacgtacacgaccggtgctcgatttagtgagtcagtaaggggcctgaagactttttatgggctggtcgcaccctgtgcaggagtcagtctcagtcaggacacagcatggacatgagggtccccgctcagctcctggggctcctgctactctggctccgagatgtgacatccagatgacccagtctccatcctccctgtctgcatctgtgggagacagagtcaccatcacttgccgggcaagtcagaggattagcagttatttaaattggtgtcagcagaagccagggagagcccctaaggtcctgatctatgcttcatccagtttgcaaagtggggtcccatcaaggttcagtggcagtggatctgggacagatttcactctcaccatcagcggtctgcaacctgaagattttgcaacttacttctgtcaacagagttacaataccccctccgtcacctgcggccaagggacacgg

SEQ ID NO: 556911 - DNA, 498 bp, Homo sapiens
  misc_feature: HIJSMM301DQSSO.13.6.A06.1.454.light.4.raw
tcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccgtctcctgcaggtccagtcagagcctcctgcatagaaatggatataactatttggattggtatctgcagaggccagggcagtccccacaactcctgatctattggggttctaatcgggcctccggggtccctaacaggttcagtggcagtggatcaggcacagattttacactgaaaatcagcagagtggaggctgaggatgttggggtttattactgcatgcaagctctacaacctctgcggactttcggccctgggaccaaagtggagatcaaacgaactagtggctgcaccatctgtcttcta

SEQ ID NO: 556912 - DNA, 498 bp, Homo sapiens
  misc_feature: HIJSMM301CV4FR.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcaacagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtggaggtcaaacgaactgtggctgcaccatctgtcttcatcttccccg

SEQ ID NO: 556913 - DNA, 500 bp, Homo sapiens
  misc_feature: HIJSMM301CRIY9.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaatcatgatttatgatgtcagtaatcggccctcaggggtttctaatcgcttctctggctccaagtctggcaacacggcctccctgacccatctctgggctccaggctgaggacgaggctgattattactgcagctcatatacaagcagcagcactcaagtcttcggaactgggaccaaggtcaccgtcctaagtcagcccaaggccaacccct

SEQ ID NO: 556914 - DNA, 444 bp, Homo sapiens; identical to SEQ ID NO: 535027
  misc_feature: HIJSMM301A21TX.8.73.G07.1.454.light.4.raw

SEQ ID NO: 556915 - DNA, 473 bp, Homo sapiens
  misc_feature: HIJSMM301AH62F.13.42.D09.1.454.light.4.raw
tcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcactttatttctgtcaccagtatggaactgtggctgcaccatctgtcttcatcttcccgccatctgatagtacgtga

SEQ ID NO: 556916 - DNA, 506 bp, Homo sapiens
  misc_feature: HIJSMM301BLAWT.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcggggcgttcggccaagggaccaaggtggaaatcaaaacgaactagtggctgcaccatctgtcttcatcttccccg

SEQ ID NO: 556917 - DNA, 493 bp, Homo sapiens; identical to SEQ ID NO: 536769
  misc_feature: HIJSMM301DEIQC.19.83.H06.1.454.light.4.raw

SEQ ID NO: 556918 - DNA, 497 bp, Homo sapiens
  misc_feature: HIJSMM301AE2XX.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgcagtttattactgtcagcagtataattactggcctcggacgttcggccaagggaccgaacggtaggaagtacaaacgaactagtggcgtgcaccatctgtctt

SEQ ID NO: 556919 - DNA, 484 bp, Homo sapiens
  misc_feature: HIJSMM301BIG99.5.42.D09.1.454.light.4.raw
atcagacacgcacgaccggtgctcgatttagacacatacgcagggaaagggggagtcagactcagtcaggacacagcatggacatgagggtccccgctcagctcctggggctcctgctgctctggctcccaggtgccgagggtgacatccagctgacccagacgccctccaccgtgtctgcattcgtaggagacagagtcacgatcacctgtcgggccagtcagaatattaacagatggttggcctggtatcaccagagaccaggagaagccccaaacctcctcatttttgatgcctccactttgaatggaggggtcccaccaacattcagcggcagtggatctgggacagagttcactctcacaatcagcagcctgcagcctgatgatcttggaacttattactgccaacaatataatagttattggacgttcggccagggacgaaggtcgaaatgagacgaactgtggctgcaccatctgtt

SEQ ID NO: 556920 - DNA, 487 bp, Homo sapiens
  misc_feature: HIJSMM301CRALW.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtaacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtggcccgctcattttcggcggagggaccaaggtgcagatcaaacgaactgtggctgcacca

SEQ ID NO: 556921 - DNA, 488 bp, Homo sapiens; identical to SEQ ID NO: 535568
  misc_feature: HIJSMM301AJ6IS.21.4.A04.1.454.light.4.raw

SEQ ID NO: 556922 - DNA, 492 bp, Homo sapiens; identical to SEQ ID NO: 538644
  misc_feature: HIJSMM301AL1CI.26.78.H01.1.454.light.4.raw

SEQ ID NO: 556923 - DNA, 478 bp, Homo sapiens
  misc_feature: HIJSMM301B9QUD.7.67.G01.1.454.light.4.raw
  modified_base (463)..(463): a, c, t, g, unknown or other
cgtgtctctacacgaccggtgctcgatttagagtatacatattgggtttgggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctcccacagcggggcaggttctgatgttcactggtaccagcagcttccagggacagcccccaaactcctcatatacgagaacaccaatcggccctcaggagtccctgaccgattctctggctccaagtctggcacctcagccctccctggccatcactgggctccaggctgaggatgaggctgattatactgccagtcgtatgacagcagcctgagtgtttgggngttcgggcggaggga

SEQ ID NO: 556924 - DNA, 481 bp, Homo sapiens
  misc_feature: HIJSMM301EDMUZ.5.34.D01.1.454.light.4.raw
atcagacacgcacgaccggtgctcgatttagatcgtctgtgttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttccctcgaccttcgccaaggacacgactggagattaaacgaactagtggctgcacca

SEQ ID NO: 556925 - DNA, 491 bp, Homo sapiens; identical to SEQ ID NO: 544714
  misc_feature: HIJSMM301EGWC4.18.11.A11.1.454.light.4.raw

SEQ ID NO: 556926 - DNA, 523 bp, Homo sapiens
  misc_feature: HIJSMM301EYZS7.41.19.B08.1.454.light.4.raw
tctatactatcacgaccggtgctcgatttagtgagtcagtaaggggggggtcgtcaggaggcagcgctctcgggacgtctccaccatggcctgggctctgctatccctccaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccacgactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaaccccactgtcactctgttcccgccctcctcat

SEQ ID NO: 556927 - DNA, 507 bp, Homo sapiens
  misc_feature: HIJSMM301C7UF1.47.85.H08.1.454.light.4.raw
agctcacgtacacgaccggtgctcgatttagtatcactcagtcgcgggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttggcaactactgtcgtttgggtgttcggcggagggaccaagttgaccgtcctaggtcagcccaaggctcgccccctggtcactctgtt

SEQ ID NO: 556928 - DNA, 434 bp, Homo sapiens; identical to SEQ ID NO: 535153
  misc_feature: HIJSMM301CVXAA.18.5.A05.1.454.light.4.raw

SEQ ID NO: 556929 - DNA, 362 bp, Homo sapiens
  misc_feature: HIJSMM301BVI9C.3.57.F02.1.454.light.4.raw
agacgcactccacgaccggtgctcgatttagctcgatatagttgggtttgggggtgtggtggtctccactcccgccttgacggggctgctatctgccttccaggcccctatcctggtcatcaattatgacagcgaccggccctcgagggatccctgagcgattctctggctccaactctgggaacacggccaccctgaccatcaccagggtcgaggccgaggatgaggccgactattactgtcaggtgtgggatagccgttctgatcattgggtcttcggcggcgggaccaagctgaccgtcctatgtcaacccaaggctggcccctcggtcacctctgttcccacctcctcgagtgcgtct

SEQ ID NO: 556930 - DNA, 483 bp, Homo sapiens
  misc_feature: HIJSMM301A3JTV.4.27.C05.1.454.light.4.raw
agcactgtagcacgaccggtgctcgatttagacgcgatcgaagggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcgtcctacatagtaatggatacaactatttggattggtacctgcagaagccagggcagtctccacagctcctgatctatttgggttctaaccgggcctccggggtccctgacaggttcagtggcagtggatcaggcacagattttacactgagaatcagcagagtggaggctgaggatgttggggtttactactgcatgcaagctctacaagccacctacacttttggccaggggaccaggctggagatcaaacgaa

SEQ ID NO: 556931 - DNA, 497 bp, Homo sapiens
  misc_feature: HIJSMM301EBFIV.52.28.C06.1.454.light.4.raw
cgcagtacgacacgaccggtgctcgatttagagctcacgtattgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcacgtcctgggtcagcccaaggccaaccccactgtcacttc

SEQ ID NO: 556932 - DNA, 505 bp, Homo sapiens
  misc_feature: HIJSMM301BRABP.8.1.A01.1.454.light.4.raw
ctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgaattgccaaagaaatatgcttattggtaccagcagaagtcaggccaggcccctgtcctggtcatttatgaggacaagaaacgaccctccgggatccctgacagactctctggctccagctcagggacagtggccaccttgactatcactggggcccaggtggaggatgaaggagactactattgttactctccagagaaggatggtcatcattgggtgttcggcggaggaccaagctgaccgtcctaagtcagccaaggctgccccctcggtcactctgtcccgccctccc

SEQ ID NO: 556933 - DNA, 508 bp, Homo sapiens
  misc_feature: HIJSMM301BN9YZ.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaactagttttctcggggcgttcggccgaagggaccgaaggtggaaatacaaacgaactagtggctgcaccatctgtcttcatcttccccg

SEQ ID NO: 556934 - DNA, 499 bp, Homo sapiens
  misc_feature: HIJSMM301EQ2L5.41.40.D07.1.454.light.4.raw
tctatactatcacgaccggtgctcgatttagtgatagagcgtaacaacagaggggagaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccgggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtctt

SEQ ID NO: 556935 - DNA, 506 bp, Homo sapiens
  misc_feature: HIJSMM301EVFWI.10.27.C05.1.454.light.4.raw
catagtagtgcacgaccggtgctcgatttagacgcgatcgaagggtttggggggggtcgacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggggtttctagtcgcttctctgcctccaagtctggcaacacggcctccctgacaatctctgggctccaggctgacgacgaggctgaatattactgcagctcatatgtagatggtgcctctttcaaggttttcggcggagggaccaggctgaccgtcctaagtcagcccaaggctgcccctcggt

SEQ ID NO: 556936 - DNA, 493 bp, Homo sapiens; identical to SEQ ID NO: 535745
  misc_feature: HIJSMM301EYE46.47.78.H01.1.454.light.4.raw

SEQ ID NO: 556937 - DNA, 447 bp, Homo sapiens
  misc_feature: HIJSMM301D6OW1.11.86.H09.1.454.light.4.raw
cgagagataccacgaccggtgctcgatttagtgctatagacttgggtcctgggcccagtctgtgctgactcagccaccctcagcgtctgggacccccgggcagagggtcatcatctcttgttctggaagcagctctaatatcggaagtaatactgtaaattggtatcaacaactcccaggaacggcccccaaactcctcatctatagtaataatcagcggccctcaggggtccctgaccgattctctggctccaagtctggcacctcagcctccctggccatcagtgggctccagtctgatgatgaggctgattattactgtgcagcatgggatgacaccctgaatggtccttgtgtggttttcggcggagggaccaagctgaccgtcctaggtcagcccaaggctgccccctcggtcactctgtcccaccctcctcgtatctctcg

SEQ ID NO: 556938 - DNA, 383 bp, Homo sapiens; identical to SEQ ID NO: 545018
  misc_feature: HIJSMM301DDDBV.41.34.D01.1.454.light.4.raw

SEQ ID NO: 556939 - DNA, 444 bp, Homo sapiens
  misc_feature: HIJSMM301E00H6.11.3.A03.1.454.light.4.raw
cgagagataccacgaccggtgctcgatttagagagcgtcacagggtccgtgggcccagtctgtgctgacgcagccgccctcagtgtctggggccccagggccagacggtcaccatctcctgcactggaaacagctccaacgtcggggcaggttatgatgttcactggtaccagcaccttccacaaacagcccccaaactcctacatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgccccctcggtccactctgttcccgcctcctcgtatctctcg

SEQ ID NO: 556940 - DNA, 488 bp, Homo sapiens; identical to SEQ ID NO: 537260
  misc_feature: HIJSMM301CRAVA.47.70.G04.1.454.light.4.raw

SEQ ID NO: 556941 - DNA, 501 bp, Homo sapiens; identical to SEQ ID NO: 549899
  misc_feature: HIJSMM301EIPLA.41.18.B07.1.454.light.4.raw

SEQ ID NO: 556942 - DNA, 493 bp, Homo sapiens; identical to SEQ ID NO: 537281
  misc_feature: HIJSMM301D1S9E.9.1.A01.1.454.light.4.raw

SEQ ID NO: 556943 - DNA, 505 bp, Homo sapiens
  misc_feature: HIJSMM301BHX1U.4.57.F02.1.454.light.4.raw
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaactccacctgtcact

SEQ ID NO: 556944 - DNA, 495 bp, Homo sapiens; identical to SEQ ID NO: 537415
  misc_feature: HIJSMM301CZB1K.4.27.C05.1.454.light.4.raw

SEQ ID NO: 556945 - DNA, 497 bp, Homo sapiens; identical to SEQ ID NO: 536371
  misc_feature: HIJSMM301BQZ13.16.78.H01.1.454.light.4.raw

SEQ ID NO: 556946 - DNA, 481 bp, Homo sapiens; identical to SEQ ID NO: 535993
  misc_feature: HIJSMM301B9ZRR.21.25.C03.1.454.light.4.raw

SEQ ID NO: 556947 - DNA, 454 bp, Homo sapiens; identical to SEQ ID NO: 535005
  misc_feature: HIJSMM301BSXA3.19.86.H09.1.454.light.4.raw

SEQ ID NO: 556948 - DNA, 485 bp, Homo sapiens; identical to SEQ ID NO: 536040
  misc_feature: HIJSMM301DCT3Q.15.1.A01.1.454.light.4.raw

SEQ ID NO: 556949 - DNA, 495 bp, Homo sapiens; identical to SEQ ID NO: 536359
  misc_feature: HIJSMM301AGAAP.48.4.A04.1.454.light.4.raw

SEQ ID NO: 556950 - DNA, 495 bp, Homo sapiens; identical to SEQ ID NO: 541961
  misc_feature: HIJSMM301DTSYG.21.27.C05.1.454.light.4.raw
  modified_base (198)..(198): a, c, t, g, unknown or other

SEQ ID NO: 556951 - DNA, 497 bp, Homo sapiens; identical to SEQ ID NO: 535286
  misc_feature: HIJSMM301A4Z1V.18.59.F04.1.454.light.4.raw

SEQ ID NO: 556952 - DNA, 475 bp, Homo sapiens
  misc_feature: HIJSMM301BCXHP.12.49.E05.1.454.light.4.raw
atacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagcaattttttagcctggtatcagcagaaaccagggaaagttccacacctcctgatctatgctgcatccgctttgcaatcaggggtcccatctcggttcagcggcagtggatctgggacagagttcactctcaccatcagcagcctgcagcctgaagatgttgcaacttattactgtcaaaagtataacagtgcccccttcacccttcggccaagggacacgactggagattagaacg

SEQ ID NO: 556953 - DNA, 490 bp, Homo sapiens; identical to SEQ ID NO: 535936
  misc_feature: HIJSMM301A9J27.16.68.G02.1.454.light.4.raw

SEQ ID NO: 556954 - DNA, 519 bp, Homo sapiens
  misc_feature: HIJSMM301CUXQ7.5.27.C05.1.454.light.4.raw
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtctaggtcagccaaggccaacccactgtcactctgttcccaccaccctcctccgtcg

SEQ ID NO: 556955 - DNA, 501 bp, Homo sapiens; identical to SEQ ID NO: 544375
  misc_feature: HIJSMM301EA125.21.8.A08.1.454.light.4.raw

SEQ ID NO: 556956 - DNA, 486 bp, Homo sapiens; identical to SEQ ID NO: 536261
  misc_feature: HIJSMM301EOQDZ.26.55.E11.1.454.light.4.raw

SEQ ID NO: 556957 - DNA, 505 bp, Homo sapiens
  misc_feature: HIJSMM301C4PZ9.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctggtcactctgttccccgccctcctcg

SEQ ID NO: 556958 - DNA, 486 bp, Homo sapiens; identical to SEQ ID NO: 537617
  misc_feature: HIJSMM301AWPNS.10.53.E09.1.454.light.4.raw

SEQ ID NO: 556959 - DNA, 488 bp, Homo sapiens; identical to SEQ ID NO: 542699
  misc_feature: HIJSMM301CA8DY.12.51.E07.1.454.light.4.raw

SEQ ID NO: 556960 - DNA, 521 bp, Homo sapiens
  misc_feature: HIJSMM301AN2JG.12.71.G05.1.454.light.4.raw
atacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgatttttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaaagtgaccgtcctaagtcagcccaaggctgccccctcggtcactctgttcccgccct

SEQ ID NO: 556961 - DNA, 498 bp, Homo sapiens
  misc_feature: HIJSMM301DMKM3.51.59.F04.1.454.light.4.raw
cgatcgtatacacgaccggtgctcgatttagtacacacacttagggattgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggcccaaccccactgtcactc

SEQ ID NO: 556962 - DNA, 509 bp, Homo sapiens
  misc_feature: HIJSMM301B0QD6.8.42.D09.1.454.light.4.raw
ctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcgggcggagggaccaagttgaccgtcctaggtcagcccaaggctgccccctcggtcactctgttcccaccct

SEQ ID NO: 556963 - DNA, 481 bp, Homo sapiens
  misc_feature: HIJSMM301BTIRD.4.39.D06.1.454.light.4.raw
agcactgtagcacgaccggtgctcgatttagtgacatctcgcagttctttggggagactcagtcaggacacagcatggacatgagggtccccgctcagctcctggggctcctgctgctctggctcccaggtgccgagggtgacatccagctgacccagtcgccctccaccgtgtctgcatccgtaggagacagagtcaccatcacctgtcgggccagtcagaatatttacagttggttggcctggtatcaccagagaccaggagaagccccaaacctcctcatttatgatgcctccactttgaatggaggggtcccaccaacattcagcggcagtggatctgggacagagttcactctaaccatcagcagcctgcagcctgatgatcttggaacttatttctgccagcaatataatagttattggacgttcggccaggggaccaaggtcgaaatgagacgaactgtggctgcacatctgtt

SEQ ID NO: 556964 - DNA, 492 bp, Homo sapiens
  misc_feature: HIJSMM301A2667.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgctactttattactgtcagcagcgtagcaactggcctctcactttcggcggagggaccagggtggagatcagacgaactgtggctgcaccatctgtt

SEQ ID NO: 556965 - DNA, 497 bp, Homo sapiens; identical to SEQ ID NO: 542618
  misc_feature: HIJSMM301AS0XP.16.46.E02.1.454.light.4.raw

SEQ ID NO: 556966 - DNA, 503 bp, Homo sapiens; identical to SEQ ID NO: 548067
  misc_feature: HIJSMM301DS6PZ.9.53.E09.1.454.light.4.raw

SEQ ID NO: 556967 - DNA, 482 bp, Homo sapiens
  misc_feature: HIJSMM301D4XWI.26.37.D04.1.454.light.4.raw
agactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccagggtggagatcagacgaactgtggctgca

SEQ ID NO: 556968 - DNA, 526 bp, Homo sapiens
  misc_feature: HIJSMM301EZTP7.14.70.G04.1.454.light.4.raw
  modified_base (233)..(233): a, c, t, g, unknown or other
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggancccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctggtgggcaggtcacgcccaacggcccaacccccactgtccactcttcccg

SEQ ID NO: 556969 - DNA, 482 bp, Homo sapiens; identical to SEQ ID NO: 537205
  misc_feature: HIJSMM301D82AJ.5.39.D06.1.454.light.4.raw

SEQ ID NO: 556970 - DNA, 500 bp, Homo sapiens
  misc_feature: HIJSMM301BVKDK.7.5.A05.1.454.light.4.raw
cgtgtctctacacgaccggtgctcgatttagatagatagacagggggggtcgtcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcaggggtttccgaatcgcttctctggctccaagtctggcgacacggcctccctcgaccactctctgggctccaggctgaagacgaggctgattattactgcagctcatatacaggcagcagcactcaggttttcggcggagggaccaagctgaccgtcctaggtcagcccaaggctgccccctcggt

SEQ ID NO: 556971 - DNA, 489 bp, Homo sapiens; identical to SEQ ID NO: 535250
  misc_feature: HIJSMM301CL0BS.14.55.E11.1.454.light.4.raw

SEQ ID NO: 556972 - DNA, 486 bp, Homo sapiens; identical to SEQ ID NO: 535043
  misc_feature: HIJSMM301DSXGH.46.35.D02.1.454.light.4.raw

SEQ ID NO: 556973 - DNA, 496 bp, Homo sapiens; identical to SEQ ID NO: 535541
  misc_feature: HIJSMM301CAT0F.3.33.C11.1.454.light.4.raw

SEQ ID NO: 556974 - DNA, 453 bp, Homo sapiens
  misc_feature: HIJSMM301B9U6O.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctggtcactctgttcccgccctcctccacgagagta

SEQ ID NO: 556975 - DNA, 507 bp, Homo sapiens
  misc_feature: HIJSMM301ADN23.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaagtaggatatcaaacgaactagtggctgcaccatctgtctt

SEQ ID NO: 556976 - DNA, 515 bp, Homo sapiens
  misc_feature: HIJSMM301B1RKS.13.38.D05.1.454.light.4.raw
  modified_base (362)..(362): a, c, t, g, unknown or other
  modified_base (424)..(424): a, c, t, g, unknown or other
  modified_base (462)..(462): a, c, t, g, unknown or other
  modified_base (484)..(484): a, c, t, g, unknown or other
tcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaactcctgatctacggtacatccactttgcacagtgggatcccatcaaggttcagtggcagtagatctggaacagatttttacccncaccatcaggggtctacagcctgaagattttgcgacttactattgtcaacagagttaccttntcccccggacgttcgcgacggacgaacgtggaacgtanaacgcgaactacgtggcgtcgngaccatactcgtcttctatacttccgtcccc

SEQ ID NO: 556977 - DNA, 496 bp, Homo sapiens
  misc_feature: HIJSMM301C8SWX.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgtcggccaagggaccaaagtaggacgatcaagacgaactgtggcgtgcgaccatcctgtt

SEQ ID NO: 556978 - DNA, 484 bp, Homo sapiens
  misc_feature: HIJSMM301E0FYN.15.28.C06.1.454.light.4.raw
tctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtgggtcccatcaaggttcagcggcagtggatctgggacagaattcagtctcaccatcagcagcctgcagcctgacgattttgcaacttactactgccaagtgcataataatcatttcggcggagggaccaaggtggagatcaaacgaactgtggctgcaccatctgtcttcatt

SEQ ID NO: 556979 - DNA, 502 bp, Homo sapiens
  misc_feature: HIJSMM301AQZ2C.49.39.D06.1.454.light.4.raw
agtcgagagacacgaccggtgctcgatttagtgacatctcgcagttctttgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaggcagctccaacattgggactaattatgtttcctggtaccagcacctcccaggaacagcccccaaacgcctcatctatgaagataataagcgaccctcagggattcctgaccgattctctggctccaagtctggcacgtcagccaccctggacatcaccggactccagactggggacgaggccgattattactgcggaacatgggatagcagcctgagtgttgtgattttcggcggagggaccaagctgaccgtcctaggtcagcccaaggctgccccctcggtcact

SEQ ID NO: 556980 - DNA, 497 bp, Homo sapiens; identical to SEQ ID NO: 535286
  misc_feature: HIJSMM301EN5G1.18.59.F04.1.454.light.4.raw

SEQ ID NO: 556981 - DNA, 476 bp, Homo sapiens
  misc_feature: HIJSMM301BP1OT.12.1.A01.1.454.light.4.raw
atacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtgggtcccatcaaggttcagtggcagtgggtctgggacagatttcactctcaccatcagcagtctgcaacctgaagattctgcaacttattactgtcaacagagtaacagttaccctcccactttcggcggagggaccaaggtggagatcaaacgaactgtggctgcaccatctgtt

SEQ ID NO: 556982 - DNA, 490 bp, Homo sapiens
  misc_feature: HIJSMM301CXK0Z.51.38.D05.1.454.light.4.raw
cgatcgtatacacgaccggtgctcgatttagtatctgatagttgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggatccctgagcgattctctggctccaactctgggaacacagccactctgaccatcagcgggacgcaggctgtggatgaggctgacttttactgtcaggcgtgggacagcgacactgccgtgttcggcgggggaccaagctgaccgtcctcggtcagcccaaggctgccccctcggt

SEQ ID NO: 556983 - DNA, 447 bp, Homo sapiens
  misc_feature: HIJSMM301AM3F7.18.9.A09.1.454.light.4.raw
tacgagtatgcacgaccggtgctcgatttagcgagacgcgcagggtcctgggcccagtctgtgctgacgcagccgccctcagtgtctgtggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccgccctcctccatactcgta

SEQ ID NO: 556984 - DNA, 504 bp, Homo sapiens; identical to SEQ ID NO: 552754
  misc_feature: HIJSMM301EPB92.2.35.D02.1.454.light.4.raw

SEQ ID NO: 556985 - DNA, 495 bp, Homo sapiens; identical to SEQ ID NO: 537415
  misc_feature: HIJSMM301CX438.4.27.C05.1.454.light.4.raw

SEQ ID NO: 556986 - DNA, 493 bp, Homo sapiens
  misc_feature: HIJSMM301BJFXX.51.21.B10.1.454.light.4.raw
cgatcgtatacacgaccggtgctcgatttagtgtcgtcgcagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgattattattgtcaatcaacagacaccattggtacttatgtcttcggaactgcgaccaaggtcacgtcctgggtcagcccaaggccaaccccactgtcta

SEQ ID NO: 556987 - DNA, 496 bp, Homo sapiens
  misc_feature: HIJSMM301AIIY8.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcacttcggtcggagggaccgaacggacggacgatacagacgaactgtggcgtgcaccactctgtcttcta

SEQ ID NO: 556988 - DNA, 502 bp, Homo sapiens
  misc_feature: HIJSMM301BLRG7.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggctttcggcgagggaccaagctgaccgtcctgggtcagcccaaggctgccccctcggtca

SEQ ID NO: 556989 - DNA, 503 bp, Homo sapiens; identical to SEQ ID NO: 536834
  misc_feature: HIJSMM301BEC9R.2.35.D02.1.454.light.4.raw

SEQ ID NO: 556990 - DNA, 488 bp, Homo sapiens; identical to SEQ ID NO: 541987
  misc_feature: HIJSMM301BCKAT.8.12.B01.1.454.light.4.raw

SEQ ID NO: 556991 - DNA, 489 bp, Homo sapiens
  misc_feature: HIJSMM301AY2J1.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatcgaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattattacttcgtggacgttcggccaagggaccaaggtggatatcagacgaa

SEQ ID NO: 556992 - DNA, 486 bp, Homo sapiens; identical to SEQ ID NO: 540808
  misc_feature: HIJSMM301AQODP.26.70.G04.1.454.light.4.raw

SEQ ID NO: 556993 - DNA, 486 bp, Homo sapiens; identical to SEQ ID NO: 535385
  misc_feature: HIJSMM301D0C1N.19.71.G05.1.454.light.4.raw

SEQ ID NO: 556994 - DNA, 516 bp, Homo sapiens; identical to SEQ ID NO: 535549
  misc_feature: HIJSMM301D6WA2.14.70.G04.1.454.light.4.raw

SEQ ID NO: 556995 - DNA, 510 bp, Homo sapiens
  misc_feature: HIJSMM301AVS8I.8.38.D05.1.454.light.4.raw
ctcgcgtgtccacgaccggtgctcgatttagtatctgatagttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaaattgagatcaaacgaactagtggctgcaccatctgtcttcatcttcccg

SEQ ID NO: 556996 - DNA, 499 bp, Homo sapiens; identical to SEQ ID NO: 539172
  misc_feature: HIJSMM301A545L.48.36.D03.1.454.light.4.raw

SEQ ID NO: 556997 - DNA, 511 bp, Homo sapiens
  misc_feature: HIJSMM301AT6M9.10.71.G05.1.454.light.4.raw
catagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccgaaaatagaggtcaaacgaactagtggctgcaccatctgtcttctatcttccccg

SEQ ID NO: 556998 - DNA, 496 bp, Homo sapiens; identical to SEQ ID NO: 539888
  misc_feature: HIJSMM301BJSJC.15.58.F03.1.454.light.4.raw

SEQ ID NO: 556999 - DNA, 495 bp, Homo sapiens
  misc_feature: HIJSMM301BJOQ4.52.34.D01.1.454.light.4.raw
cgcagtacgacacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcacgtcctgggtcagcccaaggccaaccccactgtcact

SEQ ID NO: 557000 - DNA, 481 bp, Homo sapiens; identical to SEQ ID NO: 535993
  misc_feature: HIJSMM301D4M0E.21.25.C03.1.454.light.4.raw

SEQ ID NO: 557001 - DNA, 489 bp, Homo sapiens; identical to SEQ ID NO: 536663
  misc_feature: HIJSMM301B1PRL.16.72.G06.1.454.light.4.raw

SEQ ID NO: 557002 - DNA, 482 bp, Homo sapiens
  misc_feature: HIJSMM301CV98O.49.81.H04.1.454.light.4.raw
agtcgagagacacgaccggtgctcgatttagtagtgtagattcgcggggaggagtcagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatctaccactcactttcggcggagggaccacggtggagatcaaacgaactgtggctgcaccat

SEQ ID NO: 557003 - DNA, 434 bp, Homo sapiens; identical to SEQ ID NO: 535153
  misc_feature: HIJSMM301BRMV9.18.5.A05.1.454.light.4.raw

SEQ ID NO: 557004 - DNA, 486 bp, Homo sapiens; identical to SEQ ID NO: 535290
  misc_feature: HIJSMM301EPWCM.3.12.B01.1.454.light.4.raw

SEQ ID NO: 557005 - DNA, 481 bp, Homo sapiens
  misc_feature: HIJSMM301AQ0TN.48.38.D05.1.454.light.4.raw
agtatacatacacgaccggtgctcgatttagtatctgatagttgggtttgggggctgtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagccc

SEQ ID NO: 557006 - DNA, 489 bp, Homo sapiens
  misc_feature: HIJSMM301CFH2A.12.23.C01.1.454.light.4.raw
atacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaagagccaccctctcctgcagggccagtcagagtgttaatagcgacttagcctggtaccagcagatacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcagcagtataataactggttcctgctcactttcggcgggggaccgaaggtggagatcagacgaactgtggctgcaccat

SEQ ID NO: 557007 - DNA, 501 bp, Homo sapiens; identical to SEQ ID NO: 539940
  misc_feature: HIJSMM301DN8T2.5.24.C02.1.454.light.4.raw

SEQ ID NO: 557008 - DNA, 503 bp, Homo sapiens
  misc_feature: HIJSMM301BGCAA.19.78.H01.1.454.light.4.raw
  modified_base (362)..(362): a, c, t, g, unknown or other
  modified_base (500)..(500): a, c, t, g, unknown or other
tactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcgaggggtttctaatcgcttctctggctccaagtctggcaacncggcctccctgacaatctctgggctccaggctgaggacgaggctgattactactgctgctcatatgcaggtcgtatctcttatgtcttcggaatggaaccaaggtcaccgtcctaggtcagcccaaggcccaaacccnctg

SEQ ID NO: 557009 - DNA, 504 bp, Homo sapiens
  misc_feature: HIJSMM301DTPGT.16.49.E05.1.454.light.4.raw
tgtactactccacgaccggtgctcgatttagagcgactagcaacacacaaaggggggggtcgacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttgggggttataaccttgtctcctggtaccagcagcacccagacaaagcccccaaactcatgatttatgagggcaataagcggccctcaggagtttctaatcgcttctctggctccacgtctggcaacacggcctccctgacaatctctggcctccaggctgaggacgaggctgattattactgctgctcatattcaagtcgtgtcactatgctttttggcggagggaccaaggtgaccgtcctaggtcagcccaaggctgccccccg

SEQ ID NO: 557010 - DNA, 494 bp, Homo sapiens; identical to SEQ ID NO: 534992
  misc_feature: HIJSMM301C2DUI.9.1.A01.1.454.light.4.raw

SEQ ID NO: 557011 - DNA, 484 bp, Homo sapiens; identical to SEQ ID NO: 535400
  misc_feature: HIJSMM301CC4HB.46.26.C04.1.454.light.4.raw

SEQ ID NO: 557012 - DNA, 501 bp, Homo sapiens
  misc_feature: HIJSMM301BHFUL.12.12.B01.1.454.light.4.raw
atacgacgtacacgaccggtgctcgatttagtagtgtagattccgcgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagctgcattgccaataaaatctccttattggtaccagcagaagtcaggccaggcccctgtattggtcatctatgaggacaacagacgaccttccgggatccctgagagattctctggctccacctcagggacaatggccaccttgactatcagtggcgcccaggtggaggatgaggctgactactattgttattcaacagacagcactacaagtcattgggtgttcggcggagggaccaagctgaccgtcctacgtcagcccaaggctgccccctcggtcactctgtt

SEQ ID NO: 557013 - DNA, 508 bp, Homo sapiens
  misc_feature: HIJSMM301A71NI.43.67.G01.1.454.light.4.raw
tgtgagtagtcacgaccggtgctcgattagagtatacatattgggtttgggggagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgttatactccgccgacgttcggccgggggaccgaccgtggaaatcaaacgaactgtggctgcaccatctgtctt

SEQ ID NO: 557014 - DNA, 498 bp, Homo sapiens
  misc_feature: HIJSMM301C9IM9.19.67.G01.1.454.light.4.raw
tactctcgtgcacgaccggtgctcgatttagagtatacatattgggtttgggggtagctcaggaagcagagcctggagcatctccactatggcctgggctccactacttctcaccctcctcgctcactgcacaggttcttgggccaactttatgctgactcagccccactctgtgtcggagtctccggggaagacggtaaccatctttgcacccacaacagtggcaacattgccagcaattttgtgcagtggtaccagcagcgcccgggcagttcccccaccattgtgatctatgaggataatcaaagaccgtctggggtccctgatcggttctctggctccatcgacagctcctccaactctgcctccctcaccatctctggactgaagactgaggacgaggctgactactactgtcagtcttatgatagccgcggtcatgtggtcttcggcggaggaccaagctgaccgtctaggtcagcccaaggctcgcccctc

SEQ ID NO: 557015 - DNA, 482 bp, Homo sapiens; identical to SEQ ID NO: 535352
  misc_feature: HIJSMM301CZCPT.16.81.H04.1.454.light.4.raw

SEQ ID NO: 557016 - DNA, 488 bp, Homo sapiens
  misc_feature: HIJSMM301BMJ8C.3.12.B01.1.454.light.4.raw
agacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggctcccaggctcctcatctatgatgcatccaccagggccaccggtatcccagccaggttcagtggcagtgggtctgggacagagttcactctcaccatcagcagcctgcagtctgaggattttgctagtttattactgtcagcattacaataactggcctcggctcactttcggcggagggaccaaggtggagatcaaacgaactagtggctgcaccat

SEQ ID NO: 557017 - DNA, 512 bp, Homo sapiens
  misc_feature: HIJSMM301A18P1.48.41.D08.1.454.light.4.raw
agtatacatacacgaccggtgctcgatttagtcacgcgagaaagggaaaggggagtctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatccggtcttcggcggagggaccaagttgaccgtcctaagtcagcccaaggctgccccctcggtcactctgttccc

SEQ ID NO: 557018 - DNA, 496 bp, Homo sapiens
  misc_feature: HIJSMM301AF0ZK.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgcagtttattactgtcagcagtataattactggcctcggacgttcggtccaagggaccgaaggtaggaaggtcaaacgaactagtggctgcaccatctgtctt

SEQ ID NO: 557019 - DNA, 500 bp, Homo sapiens
  misc_feature: HIJSMM301DWQ66.18.78.H01.1.454.light.4.raw
  modified_base (494)..(494): a, c, t, g, unknown or other
tacgagtatgcacgaccggtgctcgatttagtgtgagtagtttgggtttgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttcaatcgcttctctggctccaagtctggcaacacggcctccctgaccatctctgggctccaggctgaggacgaggctgattattactgcagctcatatacaagcagcagcactcaagtctggaactgggaccaaggtcaccgtctaggtcagcccaaggccaacccnctgtca

SEQ ID NO: 557020 - DNA, 504 bp, Homo sapiens
  misc_feature: HIJSMM301DG7WC.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaaacatgggatgacaatctgagcggttgggtgttcggcggagggaccaaacgtgaccgtcctaggtcagcccaa

SEQ ID NO: 557021 - DNA, 505 bp, Homo sapiens; identical to SEQ ID NO: 539908
  misc_feature: HIJSMM301BZMC4.8.28.C06.1.454.light.4.raw

SEQ ID NO: 557022 - DNA, 454 bp, Homo sapiens; identical to SEQ ID NO: 534964
  misc_feature: HIJSMM301C8NWH.19.86.H09.1.454.light.4.raw

SEQ ID NO: 557023 - DNA, 501 bp, Homo sapiens; identical to SEQ ID NO: 537690
  misc_feature: HIJSMM301DN9SO.41.14.B03.1.454.light.4.raw

SEQ ID NO: 557024 - DNA, 510 bp, Homo sapiens
  misc_feature: HIJSMM301C0VNO.13.3.A03.1.454.light.4.raw
tcacgtactacacgaccggtgctcgatttagagagcgtcacaggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaacacccaggcaaagcccccaaactcattatttacggggtcaataagcggccctcagggctttctgatcgcttctctggctccaagtctggcaacacggcctccctgacaatctctggactccaggccgaggacgaggctgatttttactgttgttcatatgcaggaaggagtgattatgtctttggaagtgggaccaaggtcaccgtccttggtcagcccaaggccaaccccactgtcactctgttccca

SEQ ID NO: 557025 - DNA, 486 bp, Homo sapiens; identical to SEQ ID NO: 544651
  misc_feature: HIJSMM301DRA62.17.34.D01.1.454.light.4.raw

SEQ ID NO: 557026 - DNA, 493 bp, Homo sapiens; identical to SEQ ID NO: 535084
  misc_feature: HIJSMM301CO3CV.47.64.F09.1.454.light.4.raw

SEQ ID NO: 557027 - DNA, 481 bp, Homo sapiens
  misc_feature: HIJSMM301EOPSJ.10.1.A01.1.454.light.4.raw
catagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagctcctctccgacaggaataacatccggccctcagggatctcagagagattctctgcatccaggtcaggaagcacagcctccctgaccattactggactccaggctgacgacgaagctgattattactgctcagcatgggacaccggcctcagtgcgtgggttttcggcggagggaccaagctgaccgtcctaggtcacg

SEQ ID NO: 557028 - DNA, 492 bp, Homo sapiens
  misc_feature: HIJSMM301B5RGU.51.6.A06.1.454.light.4.raw
cgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgattctctggctccacctcagggacaatggtcacattgaccatcagtggagtccaggcagaagacgaggctgactatttctgtcaatcttcagacatcagtggtacttatgtcttcggaactgggaccaaggtcaccgtcctaggtcagcccaaggccaacccactgtcactctcg

SEQ ID NO: 557029 - DNA, 496 bp, Homo sapiens
  misc_feature: HIJSMM301B58WK.22.5.A05.1.454.light.4.raw
acatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaagagccaccctctcctgcagggccagtcagagtgttaactactacttagcctggtaccaacagaaacctgaccaggctcccaggctcctcatctatgatgcatcttacagggccactggcatcccagccaggttcagtggcagtgggtctgggacagacttcactctcaccatcagcagcctagagcctgaagattttgcagtttattactgtcagcagcgtagcaactccctcacgttcggcggagggaccaaggtggagatacaaacgaactgtggctgcaccatctgtcttcatcttcccgcc

SEQ ID NO: 557030 - DNA, 510 bp, Homo sapiens; identical to SEQ ID NO: 538614
  misc_feature: HIJSMM301BJTT9.19.59.F04.1.454.light.4.raw

SEQ ID NO: 557031 - DNA, 504 bp, Homo sapiens
  misc_feature: HIJSMM301CJMH1.19.78.H01.1.454.light.4.raw
tactctcgtgcacgaccggtgctcgatttagtgtgagtagtttgggtttgggggggtcacaagaggcagcgctctcggacgtctccaccatggcctgggctctgctgctcctcactctcctcactcaggacacagggtcctgggcccagcctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtctatctcttatgtcttcggaactgggaccaaggtcaccgtcctaggtcagcccaaggcccaaccccactgtca

SEQ ID NO: 557032 - DNA, 485 bp, Homo sapiens; identical to SEQ ID NO: 550890
  misc_feature: HIJSMM301BJXSL.52.69.G03.1.454.light.4.raw

SEQ ID NO: 557033 - DNA, 507 bp, Homo sapiens
  misc_feature: HIJSMM301DH38F.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacatcaaacgaactgtggctgcaccatctgtcttcatcttcccgccta

SEQ ID NO: 557034 - DNA, 490 bp, Homo sapiens; identical to SEQ ID NO: 543909
  misc_feature: HIJSMM301EWCE8.14.55.E11.1.454.light.4.raw

SEQ ID NO: 557035 - DNA, 496 bp, Homo sapiens; identical to SEQ ID NO: 556037
  misc_feature: HIJSMM301DEM68.41.38.D05.1.454.light.4.raw

SEQ ID NO: 557036 - DNA, 521 bp, Homo sapiens
  misc_feature: HIJSMM301CSGLO.5.27.C05.1.454.light.4.raw
atcagacacgcacgaccggtgctcgatttagacgcgatcgaagggtttggggagtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgttcccgccctcctccgtcg

SEQ ID NO: 557037 - DNA, 512 bp, Homo sapiens
  misc_feature: HIJSMM301E310X.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagagaccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggtccgaagggaccgaacggtaggaaagtacaaacgaaactagtggtcgtgtcaccat

SEQ ID NO: 557038 - DNA, 506 bp, Homo sapiens
  misc_feature: HIJSMM301BCT22.22.46.E02.1.454.light.4.raw
  modified_base (414)..(414): a, c, t, g, unknown or other
acatacgcgtcacgaccggtgctcgatttagactcatctacagggaaagggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtccgtcaccatctcctgcactgggaccagcagtgatgttggtgcttataactatgtctcctggtaccagcaccacccaggcaaagccccccaactcttaatttttggtgtcaataaccgcccctcaggggtccctgatcgcttctccggctccaagtctggcaacacggcctccctgaccatctctggactccaggctgacgatgagggtgacttttacngctgctcatatgcaggcaactataatatggtcttcggcggagggaccaaagtgaccgtcctaggtcagcccaaggctgccccctggtcactc

SEQ ID NO: 557039 - DNA, 489 bp, Homo sapiens; identical to SEQ ID NO: 535139
  misc_feature: HIJSMM301BI87T.14.55.E11.1.454.light.4.raw

SEQ ID NO: 557040 - DNA, 502 bp, Homo sapiens; identical to SEQ ID NO: 537816
  misc_feature: HIJSMM301CZ0NW.19.78.H01.1.454.light.4.raw

SEQ ID NO: 557041 - DNA, 489 bp, Homo sapiens
  misc_feature: HIJSMM301BCZ45.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgtcgtcgcggacgaccggtaggacgtgtcgaagacgaacgtagtggcgtgtcacact

SEQ ID NO: 557042 - DNA, 511 bp, Homo sapiens
  misc_feature: HIJSMM301D5RIT.48.87.H10.1.454.light.4.raw
agtatacatacacgaccggtgctcgatttagcagtactgcgttgggtttgggggctgtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagccaaggctgccccctcggtcactctgttccccg

SEQ ID NO: 557043 - DNA, 486 bp, Homo sapiens; identical to SEQ ID NO: 548935
  misc_feature: HIJSMM301BM7QP.47.38.D05.1.454.light.4.raw

SEQ ID NO: 557044 - DNA, 481 bp, Homo sapiens
  misc_feature: HIJSMM301BW3FK.48.40.D07.1.454.light.4.raw
agtatacatacacgaccggtgctcgatttagtgatagagcgtaacaacagaggggactgatcaggactcctcagttcaccttctcacaatgaggctccctgctcagctcctggggctgctaatgctctgggtctctggatccagtggggaaattgtgatgactcagtctccactctccctgcccgtcacccctggagagccggcctccatctcctgcaggtctagtcagagtctcctgcatagtaatggatacaattatttggattggtatttgcagaagccagggcagtctccacagctcctgatctatttgggttctaatcgggcctccggggtccctgacaggttcagtggccatggatcaggcacagatttcacactgaaaatcagcagagtggaggctgaggatgttggaggtttactactgcatgcaagctctgcatactgctcggacgttcggccaagggaccaacggtggaga

SEQ ID NO: 557045 - DNA, 494 bp, Homo sapiens
  misc_feature: HIJSMM301EE70B.3.31.C09.1.454.light.4.raw
agacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcaactacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctctcacttcggcggagggaccaaggtggagatcaaacgaactgtggctgcaccatctgtctt

SEQ ID NO: 557046 - DNA, 484 bp, Homo sapiens
  misc_feature: HIJSMM301DQPJY.17.26.C04.1.454.light.4.raw
cgtagactagcacgaccggtgctcgatttagtctagcgactttgggtttgggggtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttcagtggcagtggatctgggacagatttcactctcaccatcagcagtctgcaacctgaagattttgcaacttactactgtcaacagagttacaatacccctcggctcactttcggcggagggaccgaaggtggagatcaaacgaactgtggctgcacc

SEQ ID NO: 557047 - DNA, 503 bp, Homo sapiens; identical to SEQ ID NO: 536834
  misc_feature: HIJSMM301A8NV1.2.35.D02.1.454.light.4.raw

SEQ ID NO: 557048 - DNA, 491 bp, Homo sapiens; identical to SEQ ID NO: 538021
  misc_feature: HIJSMM301BVL6O.3.72.G06.1.454.light.4.raw

SEQ ID NO: 557049 - DNA, 383 bp, Homo sapiens; identical to SEQ ID NO: 447524
  misc_feature: HIJSMM301EUQ6G.41.26.C04.1.454.light.4.raw

SEQ ID NO: 557050 - DNA, 512 bp, Homo sapiens
  misc_feature: HIJSMM301DWL46.5.58.F03.1.454.light.4.raw
atcagacacgcacgaccggtgctcgatttagtctgatcgagaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttgggggttataaccttgtctcctggtaccaacagcaaccaggcaaacgcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcacacttttatgttcgggactgggaccaaggtcaccgtcctaggtcagcccaaggccaacccactgtcactctcg

SEQ ID NO: 557051 - DNA, 510 bp, Homo sapiens
  misc_feature: HIJSMM301BIJZP.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaagaccaaccccactgtcactctgttcccgt

SEQ ID NO: 557052 - DNA, 507 bp, Homo sapiens; identical to SEQ ID NO: 556531
  misc_feature: HIJSMM301BD9FB.15.5.A05.1.454.light.4.raw

SEQ ID NO: 557053 - DNA, 500 bp, Homo sapiens
  misc_feature: HIJSMM301CS3Y7.13.42.D09.1.454.light.4.raw
tcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctcggacgttcggtccgaagggaccgaaggtaggaaagtacaaacgaactacgtggctgcgaccatctgtt

SEQ ID NO: 557054 - DNA, 483 bp, Homo sapiens; identical to SEQ ID NO: 535413
  misc_feature: HIJSMM301ESFFP.26.78.H01.1.454.light.4.raw

SEQ ID NO: 557055 - DNA, 487 bp, Homo sapiens
  misc_feature: HIJSMM301AUHRM.17.34.D01.1.454.light.4.raw
cgtagactagcacgaccggtgctcgatttagatcgtctgtgttgggtttggggtgatcaggacttctcagttcatcttctcaccatgaggctccctgctcagctcctggggctgctaatgctctggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttcctccgacgttcggccaaggaccgaaggtggaactcaaacgaa

SEQ ID NO: 557056 - DNA, 514 bp, Homo sapiens
  misc_feature: HIJSMM301AEV01.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgtccacggacgaaggtaggaagtacaacgaactagtaggcgtgcgaccactctgtcttctactcttccccgtcccact

SEQ ID NO: 557057 - DNA, 504 bp, Homo sapiens
  misc_feature: HIJSMM301B5E2X.21.22.B11.1.454.light.4.raw
tcgtcgctcgcacgaccggtgctcgatttagacgacagctcagggtggggtcaaaaacccggggaggggggtctgatttgcatggatggactctccccctctcagagtacgaagagagggagagatctgggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctcggtccgaggatgaggctgactatta

SEQ ID NO: 557058 - DNA, 512 bp, Homo sapiens
  misc_feature: HIJSMM301BHO1B.15.34.D01.1.454.light.4.raw
tctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtgggcgtggcatttgggtgttcggcggaggaccaaactgaccgtcctaggtcagcccaaggctgccccctcggtcactctcg

SEQ ID NO: 557059 - DNA, 486 bp, Homo sapiens
  misc_feature: HIJSMM301CAPKR.49.50.E06.1.454.light.4.raw
agtcgagagacacgaccggtgctcgatttagatctactgacaacacacaagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaactatttaaattggtatcagcagaaaccagggaaagcccctaaactcctgatctacgatgcatccaatttggagacaggggtcccatcaaggttcagtggaagtggatctgggacacattttactttctaccatcagcggcctgcagcctgaagattttgcaacatattactgtcaacagtatgaagatctcccactcactttcggtcggagggaccgaacggtaggagatcagacgaactgtggctgca

SEQ ID NO: 557060 - DNA, 485 bp, Homo sapiens
  misc_feature: HIJSMM301AJZUR.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagtttattactgtcagacctatagtggtggcccgctcattttcggcggagggaccaaggtgcagatcaaacgaactgtggctgca

SEQ ID NO: 557061 - DNA, 501 bp, Homo sapiens
  misc_feature: HIJSMM301DH0VH.14.57.F02.1.454.light.4.raw
cgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgcagtttattactgtcagcagcgggcaattggccgctcactttcggcgggggaccgaaggtggagttcaaacgaactgtggctgcaccatctgtcttcatcttcccg

SEQ ID NO: 557062 - DNA, 494 bp, Homo sapiens; identical to SEQ ID NO: 535497
  misc_feature: HIJSMM301EF54Y.43.72.G06.1.454.light.4.raw

SEQ ID NO: 557063 - DNA, 521 bp, Homo sapiens; identical to SEQ ID NO: 543888
  misc_feature: HIJSMM301DNKYU.5.27.C05.1.454.light.4.raw

SEQ ID NO: 557064 - DNA, 490 bp, Homo sapiens; identical to SEQ ID NO: 535234
  misc_feature: HIJSMM301EDMHQ.17.21.B10.1.454.light.4.raw

SEQ ID NO: 557065 - DNA, 494 bp, Homo sapiens; identical to SEQ ID NO: 539784
  misc_feature: HIJSMM301D3IAU.22.57.F02.1.454.light.4.raw

SEQ ID NO: 557066 - DNA, 488 bp, Homo sapiens
  misc_feature: HIJSMM301CJRCH.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccgggtggggctgaggatgttggcatttattactgcatgcaggctatacaccttcctgccacttttggccaggggaccaagctggaggatcaggcgaacg

SEQ ID NO: 557067 - DNA, 490 bp, Homo sapiens; identical to SEQ ID NO: 535526
  misc_feature: HIJSMM301A2I0P.26.78.H01.1.454.light.4.raw

SEQ ID NO: 557068 - DNA, 473 bp, Homo sapiens
  misc_feature: HIJSMM301BZKPL.5.12.B01.1.454.light.4.raw
atcagacacgcacgaccggtgctcgatttagtagtgtagattccgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaacagtgacattggtgcttatgactatgtctcgtggtatcaaaagtatccagacacagcccccaaactcatcctttatgatgtccgtgttcggccctcaggggtttctgttcgcttctctggctccaagtctggcagcacggcctccctgaccatctctgggctccaggctgaggacgaggctgactattattgcagttcatatggtagtatgaagactcttgtgattttcggtggagggaccaagctgaccgt

SEQ ID NO: 557069 - DNA, 505 bp, Homo sapiens; identical to SEQ ID NO: 535987
  misc_feature: HIJSMM301DO5PB.18.37.D04.1.454.light.4.raw

SEQ ID NO: 557070 - DNA, 505 bp, Homo sapiens; identical to SEQ ID NO: 539292
  misc_feature: HIJSMM301DFBT3.19.85.H08.1.454.light.4.raw

SEQ ID NO: 557071 - DNA, 476 bp, Homo sapiens; identical to SEQ ID NO: 546088
  misc_feature: HIJSMM301AT6RS.13.71.G05.1.454.light.4.raw

SEQ ID NO: 557072 - DNA, 485 bp, Homo sapiens; identical to SEQ ID NO: 536040
  misc_feature: HIJSMM301CZOWQ.15.1.A01.1.454.light.4.raw

SEQ ID NO: 557073 - DNA, 493 bp, Homo sapiens; identical to SEQ ID NO: 535084
  misc_feature: HIJSMM301A6R7R.47.64.F09.1.454.light.4.raw

SEQ ID NO: 557074 - DNA, 486 bp, Homo sapiens; identical to SEQ ID NO: 537428
  misc_feature: HIJSMM301A939Z.47.62.F07.1.454.light.4.raw

SEQ ID NO: 557075 - DNA, 499 bp, Homo sapiens
  misc_feature: HIJSMM301C6NDV.4.64.F09.1.454.light.4.raw
agcactgtagcacgaccggtgctcgatttagcgcgtatacagggggagtcagacccagtcaggacacagcgtggacatgagggtccccgctcagctcctggggctcctgctgctctggttcccaggttccagatgcgacatccagatgacccagtctccatcttccgtgtctgcatctgtgggcgacagagtcaccatcacttgtcgggcgagtcaggacattgggacccgattagcctggtatcagcagaaaccagggaaagccctaacctcctcatctatgctgcgtccagtttgcacagtggggtcccattgaggttcagcggcagtggttctgagacagatttcagtctcaccatccgtgacctgcagcctgaagtattttgctaactttacttttgtctaacagaactaactctacttccctcgcctagttttcggcctaggggaccaagggtggagatacaaacgaactgtggctgcaccatctgtcttcatt

SEQ ID NO: 557076 - DNA, 481 bp, Homo sapiens; identical to SEQ ID NO: 545917
  misc_feature: HIJSMM301API21.52.5.A05.1.454.light.4.raw

SEQ ID NO: 557077 - DNA, 493 bp, Homo sapiens; identical to SEQ ID NO: 535084
  misc_feature: HIJSMM301DABJQ.47.64.F09.1.454.light.4.raw

SEQ ID NO: 557078 - DNA, 494 bp, Homo sapiens
  misc_feature: HIJSMM301A9PFV.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgcagtctgaagattttgcagtttattactgtcagcagtatgatacctggcctccgtacacttttggccggggaccaagctggaaatcaagcgaactgtggctgcaccatctgtcttcattcc

SEQ ID NO: 557079 - DNA, 487 bp, Homo sapiens; identical to SEQ ID NO: 540408
  misc_feature: HIJSMM301BBAB5.41.33.C11.1.454.light.4.raw

SEQ ID NO: 557080 - DNA, 512 bp, Homo sapiens
  misc_feature: HIJSMM301DXXHS.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaaagtcagcccaaggctgccccctggtcactctgttcccaccctcct

SEQ ID NO: 557081 - DNA, 491 bp, Homo sapiens
  misc_feature: HIJSMM301CWOF2.22.27.C05.1.454.light.4.raw
acatacgcgtcacgaccggtgctcgatttagacgcgatcgaagggtttgggggagctacaacaggcaggcaggggcagcaagatggtgctgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttattactgtcagcaatattatattcctcctcagaccgttcggccaagggaccaaggtggaaatcaaacgaactgtg

SEQ ID NO: 557082 - DNA, 488 bp, Homo sapiens; identical to SEQ ID NO: 539884
  misc_feature: HIJSMM301CE4S8.7.85.H08.1.454.light.4.raw

SEQ ID NO: 557083 - DNA, 444 bp, Homo sapiens; identical to SEQ ID NO: 535027
  misc_feature: HIJSMM301BHDKC.8.73.G07.1.454.light.4.raw

SEQ ID NO: 557084 - DNA, 491 bp, Homo sapiens; identical to SEQ ID NO: 535176
  misc_feature: HIJSMM301EH62X.13.39.D06.1.454.light.4.raw

SEQ ID NO: 557085 - DNA, 498 bp, Homo sapiens; identical to SEQ ID NO: 537020
  misc_feature: HIJSMM301A3X5H.26.26.C04.1.454.light.4.raw

SEQ ID NO: 557086 - DNA, 485 bp, Homo sapiens; identical to SEQ ID NO: 535985
  misc_feature: HIJSMM301DC4FO.15.1.A01.1.454.light.4.raw

SEQ ID NO: 557087 - DNA, 493 bp, Homo sapiens; identical to SEQ ID NO: 535047
  misc_feature: HIJSMM301CJLJK.16.53.E09.1.454.light.4.raw

SEQ ID NO: 557088 - DNA, 487 bp, Homo sapiens; identical to SEQ ID NO: 536025
  misc_feature: HIJSMM301DO1YK.17.34.D01.1.454.light.4.raw

SEQ ID NO: 557089 - DNA, 480 bp, Homo sapiens; identical to SEQ ID NO: 535442
  misc_feature: HIJSMM301AM5KP.41.17.B06.1.454.light.4.raw

SEQ ID NO: 557090 - DNA, 495 bp, Homo sapiens; identical to SEQ ID NO: 541828
  misc_feature: HIJSMM301AZB0B.19.71.G05.1.454.light.4.raw

SEQ ID NO: 557091 - DNA, 506 bp, Homo sapiens; identical to SEQ ID NO: 554070
  misc_feature: HIJSMM301BNWT7.15.5.A05.1.454.light.4.raw

SEQ ID NO: 557092 - DNA, 485 bp, Homo sapiens; identical to SEQ ID NO: 535501
  misc_feature: HIJSMM301DA1Y8.3.10.A10.1.454.light.4.raw

SEQ ID NO: 557093 - DNA, 488 bp, Homo sapiens
  misc_feature: HIJSMM301EJ4P4.17.21.B10.1.454.light.4.raw
cgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcagggtacactctggccgttcaattttggccaggggaccaaaactggataatcagacgaactgtgg

SEQ ID NO: 557094 - DNA, 484 bp, Homo sapiens; identical to SEQ ID NO: 535441
  misc_feature: HIJSMM301AUO17.26.60.F05.1.454.light.4.raw

SEQ ID NO: 557095 - DNA, 484 bp, Homo sapiens; identical to SEQ ID NO: 550726
  misc_feature: HIJSMM301BRD0D.47.62.F07.1.454.light.4.raw

SEQ ID NO: 557096 - DNA, 497 bp, Homo sapiens
  misc_feature: HIJSMM301E313Y.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcagggtacactctggccgttcacttttggtccgaggggaccgaaacctaggatatcagacgaactacgtggctgca

SEQ ID NO: 557097 - DNA, 447 bp, Homo sapiens; identical to SEQ ID NO: 535020
  misc_feature: HIJSMM301A5LQO.18.9.A09.1.454.light.4.raw

SEQ ID NO: 557098 - DNA, 497 bp, Homo sapiens; identical to SEQ ID NO: 535664
  misc_feature: HIJSMM301A3GP0.22.14.B03.1.454.light.4.raw

SEQ ID NO: 557099 - DNA, 489 bp, Homo sapiens; identical to SEQ ID NO: 536013
  misc_feature: HIJSMM301CO1P0.26.23.C01.1.454.light.4.raw

SEQ ID NO: 557100 - DNA, 472 bp, Homo sapiens; identical to SEQ ID NO: 536302
  misc_feature: HIJSMM301ELJ8X.18.76.G10.1.454.light.4.raw

SEQ ID NO: 557101 - DNA, 482 bp, Homo sapiens; identical to SEQ ID NO: 537007
  misc_feature: HIJSMM301E06SK.41.34.D01.1.454.light.4.raw

SEQ ID NO: 557102 - DNA, 496 bp, Homo sapiens; identical to SEQ ID NO: 553139
  misc_feature: HIJSMM301AKW0O.3.33.C11.1.454.light.4.raw
  modified_base (478)..(478): a, c, t, g, unknown or other

SEQ ID NO: 557103 - DNA, 485 bp, Homo sapiens
  misc_feature: HIJSMM301C5FZC.46.26.C04.1.454.light.4.raw
  modified_base (55)..(55): a, c, t, g, unknown or other
actagcagtacacgaccggtgctcgatttagtctagcgactttgggtttggggtnatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccgaaggtggagatcaaacgaa

SEQ ID NO: 557104 - DNA, 497 bp, Homo sapiens; identical to SEQ ID NO: 536371
  misc_feature: HIJSMM301C1YJF.16.78.H01.1.454.light.4.raw

SEQ ID NO: 557105 - DNA, 509 bp, Homo sapiens
  misc_feature: HIJSMM301E311E.47.23.C01.1.454.light.4.raw
agctcacgtacacgaccggtgctcgatttagtacacgtgattagggattggggctgggcctaaggaagcagcactggtggtgcctcagccatggcctggaccgttctcctcctcggcctcctctctcactgcacagactctgtgcctcctatgtactgactcagccatcctcggtggcagtggccccaggacagacggccaggattccctgtggaggaaacaacattggaagtaagagtgtacattggtaccaacagaggccaggccaggcccctgtgctggtcgtccatgatgatagcgaccggccctcagggatccctgagcgcttctctggctccaattctgggaacacggccaccctgaccatcagcgcggtcgaagccggagatgaggccgactattactgtcaggtgtgggacagtaatagtgatcccgagcaggttttcggcggtgggaccgaagctgaccgtcctaagtcagcccaaggctgccccctcggtcactctgtt

SEQ ID NO: 557106 - DNA, 493 bp, Homo sapiens; identical to SEQ ID NO: 549574
  misc_feature: HIJSMM301BR0S7.16.53.E09.1.454.light.4.raw

SEQ ID NO: 557107 - DNA, 484 bp, Homo sapiens; identical to SEQ ID NO: 535400
  misc_feature: HIJSMM301BJHIO.46.26.C04.1.454.light.4.raw

SEQ ID NO: 557108 - DNA, 469 bp, Homo sapiens
  misc_feature: HIJSMM301BE6QC.13.76.G10.1.454.light.4.raw
tcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcaccgtcctaagtca

SEQ ID NO: 557109 - DNA, 463 bp, Homo sapiens; identical to SEQ ID NO: 535008
  misc_feature: HIJSMM301DVMGN.10.9.A09.1.454.light.4.raw

SEQ ID NO: 557110 - DNA, 498 bp, Homo sapiens; identical to SEQ ID NO: 535974
  misc_feature: HIJSMM301AKF4G.22.27.C05.1.454.light.4.raw

SEQ ID NO: 557111 - DNA, 493 bp, Homo sapiens
  misc_feature: HIJSMM301BL00I.40.11.A11.1.454.light.4.raw
tctagcgactcacgaccggtgctcgatttagctacgactgcaggggcagcaagatggtgttgcagacccaggtcttcatttttctgttgctctggatctctggtgcctacggggacatcgtgatgacccagtctccagactccctggctgtgtctctgggcgagagggccaccatcaactgcaagtccagccagagtcttttatacaactccaacaagcagcactacttagcttggtaccagcagaaaccaggacagcctcctaaactgctcatttactgggcctctacccgggaatccggggtccctgaccgattcagtggcagcgggtctgggacagatttcactctgaccatcagcagcctgcaggctgaagatgtggcagtttattactgtcaacaatattatattattccgaggacgttcggccaagggaccaaggtggaaatcaaacgaactgtggctgcaccatctgtcttcatcttcccgccact

SEQ ID NO: 557112 - DNA, 495 bp, Homo sapiens; identical to SEQ ID NO: 544003
  misc_feature: HIJSMM301ENADM.3.31.C09.1.454.light.4.raw

SEQ ID NO: 557113 - DNA, 486 bp, Homo sapiens
  misc_feature: HIJSMM301CMPPX.10.2.A02.1.454.light.4.raw
catagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccaccctctcctgcagggccagtcagagtgttggcagcaggttagcctggtaccagcagaaacgtggccaggctcccaggctcctcgtatatggtgcatccaccagggccactggtatctcaggcaggttccgtggcagtgggtctgggacagagttcacttgtcaccatcagcagcctgcagtctgaagattttgcagtttattactgtcagcagtataatagctggcccgcgacgttcggccaagggaccgaggtggaattcaacgaactgtggctgcaccatctgtctt

SEQ ID NO: 557114 - DNA, 493 bp, Homo sapiens; identical to SEQ ID NO: 535084
  misc_feature: HIJSMM301DJIJ0.47.64.F09.1.454.light.4.raw

SEQ ID NO: 557115 - DNA, 490 bp, Homo sapiens
  misc_feature: HIJSMM301C4CT8.41.2.A02.1.454.light.4.raw
tctatactatcacgaccggtgctcgatttagactcatctacaggggagtcccaaccaggacacagcatggacatgagggtccctgctcagctcctggggctcctgctgctctggctctcaggcgccagatgtgacatccagatgacccagtctccatcctccctgtctgcatctttaggagacagagtcaccatctcttgtcaggcgaatgaggacattaacgtttatttaaattggtatcggcagagaccagggaaagcccctgagctcctgatttatgataaatcgaatttgaatccaggggtcccatctaggttccgtggaagtggatctgggacagactttactctcaccattagcagcctggagcctgaagatattgcaacatattactgtcaacagtctcatggtctcccccttagtttcggcggagggaccaaggttgagatcaaacgaactgtggctgcaccatcctgtcttcatcttcccg

SEQ ID NO: 557116 - DNA, 486 bp, Homo sapiens; identical to SEQ ID NO: 535043
  misc_feature: HIJSMM301D7XT2.46.35.D02.1.454.light.4.raw

SEQ ID NO: 557117 - DNA, 497 bp, Homo sapiens; identical to SEQ ID NO: 543371
  misc_feature: HIJSMM301EWMBR.7.59.F04.1.454.light.4.raw

SEQ ID NO: 557118 - DNA, 486 bp, Homo sapiens; identical to SEQ ID NO: 535043
  misc_feature: HIJSMM301AOQT8.46.35.D02.1.454.light.4.raw

SEQ ID NO: 557119 - DNA, 414 bp, Homo sapiens
  misc_feature: HIJSMM301B35L1.18.78.H01.1.454.light.4.raw
tacgagtatgcacgaccggtgctcgatttagtgtgagtagtttgggtttgggggctttgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaacccactgtcactctgttcccgccctcctccatactcga

SEQ ID NO: 557120 - DNA, 491 bp, Homo sapiens
  misc_feature: HIJSMM301BAPT1.15.49.E05.1.454.light.4.raw
tctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccactggcatcccagccacgttcagtggcagtgggtctgggacagagttcattctcaccatcagcagcctgcagtctgaagattttgcagtttattactgtcagcagtataatgactggcctccgacgttcggccaagggaccaacggtggaaatacaaacgaactagtggctgcaccat

SEQ ID NO: 557121 - DNA, 494 bp, Homo sapiens; identical to SEQ ID NO: 534994
  misc_feature: HIJSMM301AOJV4.27.78.H01.1.454.light.4.raw

SEQ ID NO: 557122 - DNA, 485 bp, Homo sapiens; identical to SEQ ID NO: 536040
  misc_feature: HIJSMM301DCWES.15.1.A01.1.454.light.4.raw

SEQ ID NO: 557123 - DNA, 448 bp, Homo sapiens
  misc_feature: HIJSMM301AH73W.47.85.H08.1.454.light.4.raw
agctcacgtacacgaccggtgctcgatttagtatcactcagtcgcggggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaacgacccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctcgccccctcggtcactctgttcccaccctcctctacgtgagct

SEQ ID NO: 557124 - DNA, 502 bp, Homo sapiens
  misc_feature: HIJSMM301DRQYI.10.43.D10.1.454.light.4.raw
catagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaagtggatatcaaacgaactgtggctgcaccatctgtcttcatt

SEQ ID NO: 557125 - DNA, 480 bp, Homo sapiens
  misc_feature: HIJSMM301DB8GK.48.28.C06.1.454.light.4.raw
agtatacatacacgaccggtgctcgatttagagctcacgtattgggtttggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagaccccg

SEQ ID NO: 557126 - DNA, 497 bp, Homo sapiens
  misc_feature: HIJSMM301CLK0T.22.65.F10.1.454.light.4.raw
acatacgcgtcacgaccggtgctcgatttagctacgctctaacggggacgtccagtctcagtcaggacacaggcagtggaacgatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgcccccccgatcaccttcggccaagggacacgactggagattaaacgaactgtggctgcaccatctgtcttcatt

SEQ ID NO: 557127 - DNA, 502 bp, Homo sapiens
  misc_feature: HIJSMM301CV6WK.48.37.D04.1.454.light.4.raw
agtatacatacacgaccggtgctcgatttagtagcatactgttgggtttgggggaactgctcagttaggacccagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggctcctcatttatgatacatccaccagggccactggtgtcccagccaggttcactggcggtgggtctgggacagagttcactctcaccatcagcagcctgcagtctgaagattttacattttattactgtcagcagtatcgtaagtggactccgacgtttggccaagggaccaaggtggaagtcaaacgaactgtggctgcaccatctgtcttcatcttcccgcc

SEQ ID NO: 557128 - DNA, 494 bp, Homo sapiens; identical to SEQ ID NO: 534994
  misc_feature: HIJSMM301BDYJI.27.78.H01.1.454.light.4.raw

SEQ ID NO: 557129 - DNA, 489 bp, Homo sapiens; identical to SEQ ID NO: 549902
  misc_feature: HIJSMM301CRU6N.43.33.C11.1.454.light.4.raw

SEQ ID NO: 557130 - DNA, 495 bp, Homo sapiens; identical to SEQ ID NO: 536931
  misc_feature: HIJSMM301CKQAO.10.33.C11.1.454.light.4.raw

SEQ ID NO: 557131 - DNA, 483 bp, Homo sapiens
  misc_feature: HIJSMM301EMTVB.53.32.C10.1.454.light.4.raw
cgcgtatacacacgaccggtgctcgatttagtatagacatcaacacacaaaggggctgggcctcaggaagcagcatcggaggtgcctcagccatggcatggatccctctcttcctcggcgtccttgcttactgcacaggatcggtggcctcctatgagctgagtcagccaccctcagtgtccgtgtccccaggacagacagtccgcatcacctgctctggagataaattgggggataaatttgcttgctggtatcaacagaagacaggccagtcccctgtgttggtcatttatcaagatgacaagcggccctcagggatccctgagcggttctctggctccaactctgggaacacagccactctgaccatcagcgggacccaggctatggatgaggctgactattactgtcaggcgtgggacagcagcactatggtgttcggcggagggaccaagctgaccgtctaggtcagcccaaggctcg

SEQ ID NO: 557132 - DNA, 503 bp, Homo sapiens
  misc_feature: HIJSMM301D8BOP.2.76.G10.1.454.light.4.raw
acgctcgacacacgaccggtgctcgatttagtcactcatacaggggggagagatctgggggaaggctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggcagagggtcaccatctcttgttctggaggcacctccaacatcgggcgtgataatgtgtactggtacaagcaggtcccaggaacgacccccaaactcctcatctctcacaataatcagcggccctcaggagtccctgaccgattctctgcctccaagtccggcacctcagcctccctggccatcagtgggctccgggccgaggatgaggctgattattactgtgcaggatgggatgacaacctgggtgcttatctcttcggacctgggaccaagtcaccgtccttggt

SEQ ID NO: 557133 - DNA, 480 bp, Homo sapiens; identical to SEQ ID NO: 535291
  misc_feature: HIJSMM301EGI7O.22.59.F04.1.454.light.4.raw

SEQ ID NO: 557134 - DNA, 481 bp, Homo sapiens
  misc_feature: HIJSMM301DTJT5.17.26.C04.1.454.light.4.raw
cgtagactagcacgaccggtgctcgatttagtctagcgactttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttcagtggcagtggatctgggacagatttcactctcaccatcagcagtctgcaacctgaagattttgcaacttactactgtcaacagagttacaatacccctcggctcactttcggcggagggaccaaggtggagatcaaacgaactgtggctgcacca

SEQ ID NO: 557135 - DNA, 520 bp, Homo sapiens
  misc_feature: HIJSMM301D1HNZ.10.86.H09.1.454.light.4.raw
catagtagtgcacgaccggtgctcgatttagtgctatagacttgggtttggggagctctgcttcagctgtgagcgcagaaggcgggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccagaccggggacgaggccgattattactgcgcaacttgggactccaacctgactgttgggctttcggcggagggactaagttgaccgtcctacgtcagcccaaggctgccccctcggtcta

SEQ ID NO: 557136 - DNA, 443 bp, Homo sapiens; identical to SEQ ID NO: 537723
  misc_feature: HIJSMM301DFMVV.8.73.G07.1.454.light.4.raw

SEQ ID NO: 557137 - DNA, 499 bp, Homo sapiens
  misc_feature: HIJSMM301BJIEQ.22.38.D05.1.454.light.4.raw
acatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccggggaaagagccaccctctcctgcagggccagtcagaatgttagtagttacttagcctggtaccagcaaaagcctggccaggctcccagactcctcatctctgatacatccaacagggccactggcatcccagccaggttcagtggcagtgggtctgggacagacttcactctcaccatcagcgacctagagcctgaagattttgcagtttattactgtcagcagcgtagcatctggcctccgtacacctttggccaggggaccaagctggagatcaaacgaactgtggctgcaccatctgtcttcatt

SEQ ID NO: 557138 - DNA, 491 bp, Homo sapiens; identical to SEQ ID NO: 535176
  misc_feature: HIJSMM301EX138.13.39.D06.1.454.light.4.raw

SEQ ID NO: 557139 - DNA, 462 bp, Homo sapiens
  misc_feature: HIJSMM301B7XIG.11.73.G07.1.454.light.4.raw
cgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctgatctacgatgcgtccaatttggaaacagaggtcccaccgaggttcagtggaagtggatctgggacagactttactctcaccatcagcagcctgcagcctgagatattgcaacatattactgtcaacagtatgatcgtctcctcaatttcggccctgggaccagagtggacatgaaacgaa

SEQ ID NO: 557140 - DNA, 512 bp, Homo sapiens
  misc_feature: HIJSMM301CTL9K.48.34.D01.1.454.light.4.raw
agtatacatacacgaccggtgctcgatttagatcgtctgtgttgggtttgggggtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctgttcccgccct

SEQ ID NO: 557141 - DNA, 505 bp, Homo sapiens
  misc_feature: HIJSMM301DBTIU.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaactagttttctcgggcgttcggccaagggaccaaggtggaaatacaaacgaactgtggctgcaccatctgtcttctatcttccccg

SEQ ID NO: 557142 - DNA, 519 bp, Homo sapiens
  misc_feature: HIJSMM301B8PCO.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggctgccccctcggtcactctcgttcccaccctcctccacg

SEQ ID NO: 557143 - DNA, 519 bp, Homo sapiens
  misc_feature: HIJSMM301C7RKK.17.33.C11.1.454.light.4.raw
cgtagactagcacgaccggtgctcgatttagagtgagctcgttgggtttggggggcgccaggggtcccttccaatatccccccagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccaccctcct

SEQ ID NO: 557144 - DNA, 490 bp, Homo sapiens; identical to SEQ ID NO: 538714
  misc_feature: HIJSMM301ADQ5Y.11.12.B01.1.454.light.4.raw

SEQ ID NO: 557145 - DNA, 499 bp, Homo sapiens
  misc_feature: HIJSMM301DLY2K.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctcctgacaatctctgggctccaggctgaggacgaggctgattattattgctgctcatatgcaggtagttacacttatgtcttcggaattgggacgacggtcaccgtcctaggtcagcccaaggccaacccca

SEQ ID NO: 557146 - DNA, 504 bp, Homo sapiens
  misc_feature: HIJSMM301EHDZN.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcttcggccaagggaccaaggtaggaaatacaaacgaactagtggctgcacatctgtcttctatcttccccg

SEQ ID NO: 557147 - DNA, 492 bp, Homo sapiens; identical to SEQ ID NO: 536175
  misc_feature: HIJSMM301CRDSU.19.83.H06.1.454.light.4.raw

SEQ ID NO: 557148 - DNA, 505 bp, Homo sapiens
  misc_feature: HIJSMM301DCKK8.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccgaaaatagaggtcaaacgaactgtggctgcaccactctgtcttcatt

SEQ ID NO: 557149 - DNA, 517 bp, Homo sapiens
  misc_feature: HIJSMM301ARRMY.15.34.D01.1.454.light.4.raw
tctacgtagccacgaccggtgctcgatttagatcgtctgtgttggggttgggaagcctgagaacacttagccttcaggagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtggggcgtggcatttgggtgttcggcggagggaccaaactgaccgtcctaggtcagcccaaggctgccccctcggtcactctgttccccg

SEQ ID NO: 557150 - DNA, 485 bp, Homo sapiens; identical to SEQ ID NO: 536263
  misc_feature: HIJSMM301DDXJ4.47.78.H01.1.454.light.4.raw

SEQ ID NO: 557151 - DNA, 499 bp, Homo sapiens; identical to SEQ ID NO: 551149
  misc_feature: HIJSMM301CPZ7X.48.34.D01.1.454.light.4.raw

SEQ ID NO: 557152 - DNA, 480 bp, Homo sapiens
  misc_feature: HIJSMM301DNGCM.8.12.B01.1.454.light.4.raw
ctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactggtcatctatcaagataacaagcggccctcagggatccctgagcgattctctggctccaactctgggaacacagccactctgaccatcagcgggacccaggctacggatgaggctgactattactgtcaggcgtgggacagcagcacctatgtggttttcggcggagggaccaagctgaccgtccttggtcagcccaaggct

SEQ ID NO: 557153 - DNA, 519 bp, Homo sapiens
  misc_feature: HIJSMM301C24I9.53.65.F10.1.454.light.4.raw
cgcgtatacacacgaccggtgctcgatttagctacgctctaaggggctgggcctaaggaagcagcactggtggtgcctcagccatggcctggaccgttctcctcctcggcctcctctctcactgcacagactctgtgacctcctatgtgctgactcagccaacctcggtgtcagtggccccaggacagacggccagcattacctgtgggggaaaccacattggagctaaaaatgtgcactggtaccagcagaagccaggccaggcccctgtgctggtcgtctataatggaagcggccggccctcatggatccctgggcgattctctggctccaagtctgggaacacggccaccctaaccatcagcagggtcgaagccggggatgaggccgactattactgtcaggtgtgggataatagtaatggtgggaattgggtgttcggcggagggaccaagctgaccgtcctaggtcagcccaaggctgccccctcggtcactctgttcccaccctcctctcgta

SEQ ID NO: 557154 - DNA, 496 bp, Homo sapiens
  misc_feature: HIJSMM301ECYQM.27.14.B03.1.454.light.4.raw
agcgtcgtctcacgaccggtgctcgatttagtgtgagtagtttgggtttcggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaaacgaactgtggctgcaccatctgtctt

SEQ ID NO: 557155 - DNA, 505 bp, Homo sapiens
  misc_feature: HIJSMM301COTRQ.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaattgagatcaaacgaactagtggctgcaccatctgtcttcatcttccgtcca

SEQ ID NO: 557156 - DNA, 484 bp, Homo sapiens; identical to SEQ ID NO: 535400
  misc_feature: HIJSMM301CRTAK.46.26.C04.1.454.light.4.raw

SEQ ID NO: 557157 - DNA, 512 bp, Homo sapiens
  misc_feature: HIJSMM301BF8BP.16.46.E02.1.454.light.4.raw
tgtactactccacgaccggtgctcgatttagactcatctacagggaaagggggggatctcaggaggcagctctctcggaatatctccaccatggcctgggctctgctcctcctcaccctcctcactcagggcacaggatcctgggctcagtctgtcctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaaccccactgtcactcttcg

SEQ ID NO: 557158 - DNA, 494 bp, Homo sapiens; identical to SEQ ID NO: 534994
  misc_feature: HIJSMM301EH03A.27.78.H01.1.454.light.4.raw

SEQ ID NO: 557159 - DNA, 488 bp, Homo sapiens
  misc_feature: HIJSMM301CTAOC.43.33.C11.1.454.light.4.raw
tgtgagtagtcacgaccggtgctcgatttagagtgagctcgttgggtttgggggcagaagtctctctcagtcaggacacagcatggacatgagggtccctgctcagctcctgggactcctgctgctctggctcccagcagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagattttctctcgtcatcactggtctacagtctgacgacggcgcaatgtacttctgtcaacactatgcctctcccccctacaatttcggtcaggggaccaagttgaacatcaatcgaactgtggctgcacc

SEQ ID NO: 557160 - DNA, 494 bp, Homo sapiens; identical to SEQ ID NO: 534994
  misc_feature: HIJSMM301ANXTJ.27.78.H01.1.454.light.4.raw

SEQ ID NO: 557161 - DNA, 497 bp, Homo sapiens
  misc_feature: HIJSMM301BNN02.48.70.G04.1.454.light.4.raw
  modified_base (376)..(376): a, c, t, g, unknown or other
agtatacatacacgaccggtgctcgatttagtgtagtgtgaagggaaagggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaagctgctcatttactcggcatccacccggaaatccggagttcctgaccgattccgtggcagcgggtctgggacagattttacnctcaccatcagtagcctgcaggctgaagatgtggcagtttattactgtcaacaatattattatactccgccgacgttcggccggggacaacgtgaatcaacgaactgtggctgcaccatct

SEQ ID NO: 557162 - DNA, 506 bp, Homo sapiens
  misc_feature: HIJSMM301BSRMO.4.71.G05.1.454.light.4.raw
agcactgtagcacgaccggtgctcgatttagtgtcgtcgcaagagagagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggccccaaaattggtcatctatgaagacgacaaacgaccctccgggatccctgagagattctctggctccagctcagggactatggccaccttgactatcagtgggcccaagtggaggatgaagctgactactactgttactcaatagagaacagtgataatttctgggtgttcggcggagggaccaaactgaccgtcctaggtcagccaaggctgccccctcggtcactctgttccccg

SEQ ID NO: 557163 - DNA, 484 bp, Homo sapiens; identical to SEQ ID NO: 535400
  misc_feature: HIJSMM301C2SNR.46.26.C04.1.454.light.4.raw

SEQ ID NO: 557164 - DNA, 499 bp, Homo sapiens
  misc_feature: HIJSMM301EGIA1.49.68.G02.1.454.light.4.raw
agtcgagagacacgaccggtgctcgatttagtcgatagtgaagggaaaggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtcgttataactttgtctcctggtaccagcaacacccaggcaaggcccccaaactcttcatttatgatgtcactaatcggccctcaggggtccctgatcgcttctctgcctccaagtctggcaacacggcctccctgaccatctctgggctccaggctgaggatgaggctcattattattgttgctcatatgcaggcaacttcgcttttgtcttcggaactgggaccgaggtcaccgtcctgggtcagcccaaggccaaacccc

SEQ ID NO: 557165 - DNA, 516 bp, Homo sapiens
  misc_feature: HIJSMM301BQGQF.9.52.E08.1.454.light.4.raw
tgatacgtctcacgaccggtgctcgatttagtcgagctctcagagagaaagggggaggaactgctcagttaggacccagagggaaccatggaagccccagcccagcttctcttcctcctgctactctggctcccagaaaacgccggagaaattgtgttggcacagtctccagccaccctgtctatgtctccaggggaaagagccaccctctcctgcagggccagtcagagtgttggtacgtccttactctggtaccaacaaaaacctggccaggctcccaggctcctcatctatgatgcatccaccagggccactggcatccccgccagattcagtggcagtgggtctgggacagacttcactctcaccatcagcagcctggaccctgaagattttgcagtttattactgtcagcagcggaccaattggcccctctccctcactttcggcgggggaccgaacggtggagcacaacgaactgtggctgcaccactctcgttcttctactccttcccg

SEQ ID NO: 557166 - DNA, 471 bp, Homo sapiens; identical to SEQ ID NO: 537461
  misc_feature: HIJSMM301A23XR.7.81.H04.1.454.light.4.raw

SEQ ID NO: 557167 - DNA, 416 bp, Homo sapiens; identical to SEQ ID NO: 535308
  misc_feature: HIJSMM301D7GM8.16.46.E02.1.454.light.4.raw

SEQ ID NO: 557168 - DNA, 496 bp, Homo sapiens
  misc_feature: HIJSMM301CRY2D.48.7.A07.1.454.light.4.raw
agtatacatacacgaccggtgctcgatttagcacgtgtcgcagggggggaagctcagcttcagctgtgggtagagaagacaggactcaggacaatctccagcatggccagcttccctctcctcctcaccctcctcactcactgtgcagggtcctgggcccagtctgtggtgactcagccaccctcagcgtctgggacccccggacagagagtcaccatctcctgttctggaagcagcgccaacattggacgtaatactgtcaactggtaccaacaactcgcaggaacggcccccaaactcctcatctatgaccatcataagcggccctcaggggtccctgaccgattctctggctccaagtctggctcttcagcctccctggccatcagtgggctccagtctgaggatgaggctgattattactgtgcagcgtgggatgacagcctgaatgcttgggtgttcggcggagggaccaaggtgaccgtcctaggtcacg

SEQ ID NO: 557169 - DNA, 497 bp, Homo sapiens; identical to SEQ ID NO: 536371
  misc_feature: HIJSMM301BRV88.16.78.H01.1.454.light.4.raw

SEQ ID NO: 557170 - DNA, 478 bp, Homo sapiens
  misc_feature: HIJSMM301CDGG0.22.59.F04.1.454.light.4.raw
acatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgttagcagcagcttagcctggtaccagcagaaacctggccaggctcccaggctcctcatctatggtgcatctacgagggccactggtatcccagccaggttcagtggcagtgggtctgggacagagttcactctcaccatcagcagcctgcagtctgaagatttgcagtttattactgtcagcactataataactggcctccgtacagttttggccaggggccaagctggagatcaaacgaa

SEQ ID NO: 557171 - DNA, 489 bp, Homo sapiens; identical to SEQ ID NO: 535091
  misc_feature: HIJSMM301D66FB.47.36.D03.1.454.light.4.raw

SEQ ID NO: 557172 - DNA, 498 bp, Homo sapiens; identical to SEQ ID NO: 541355
  misc_feature: HIJSMM301A2LS6.12.87.H10.1.454.light.4.raw

SEQ ID NO: 557173 - DNA, 480 bp, Homo sapiens; identical to SEQ ID NO: 535291
  misc_feature: HIJSMM301DMHVJ.22.59.F04.1.454.light.4.raw

SEQ ID NO: 557174 - DNA, 482 bp, Homo sapiens
  misc_feature: HIJSMM301BYZCP.49.38.D05.1.454.light.4.raw
agtcgagagacacgaccggtgctcgatttagtatctgatagttgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataattactggctcgttttggccaggggaccaagctggagatcaagcgaactgtggctgcaccat

SEQ ID NO: 557175 - DNA, 502 bp, Homo sapiens; identical to SEQ ID NO: 552832
  misc_feature: HIJSMM301CZFBA.18.11.A11.1.454.light.4.raw

SEQ ID NO: 557176 - DNA, 506 bp, Homo sapiens; identical to SEQ ID NO: 534969
  misc_feature: HIJSMM301CF996.18.37.D04.1.454.light.4.raw

SEQ ID NO: 557177 - DNA, 498 bp, Homo sapiens; identical to SEQ ID NO: 535295
  misc_feature: HIJSMM301AKVCA.15.25.C03.1.454.light.4.raw

SEQ ID NO: 557178 - DNA, 505 bp, Homo sapiens
  misc_feature: HIJSMM301B142V.18.33.C11.1.454.light.4.raw
tacgagtatgcacgaccggtgctcgatttagagtgagctcgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggagggaccaaggtggagatcaaacgaactgtggctgcaccatctgt

SEQ ID NO: 557179 - DNA, 509 bp, Homo sapiens
  misc_feature: HIJSMM301C8M5M.5.27.C05.1.454.light.4.raw
atcagacacgcacgaccggtgctcgatttagacgcgatcgaagggtttgggagggtttgggaacctatgaacattctgtaggggccactttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaacccactgtcactctgttccaccctcctccgtgtctgat

SEQ ID NO: 557180 - DNA, 500 bp, Homo sapiens
  misc_feature: HIJSMM301CVNDE.13.10.A10.1.454.light.4.raw
tcacgtactacacgaccggtgctcgatttagcgtcgatctcaggggggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatctacaacacaaacactcgctcttctggggtccctcatcgcttctctggctccatccttgggaacaaagctgcccttatcatcacgggggcccaggcagaagatgaatctgattattactgtgttctttatatgggtagtgccatttctgctgtgttcggaggaggcacccggctgacccgtcctcggtcagcccaaggctgccccatc

SEQ ID NO: 557181 - DNA, 506 bp, Homo sapiens
  misc_feature: HIJSMM301BYTF3.21.87.H10.1.454.light.4.raw
tcgtcgctcgcacgaccggtgctcgatttagcagtactgcgttgggtttggggggggtcgacaagaggcagcgctctcgggacgtctccaccatggcctgggctctgctgctcctcactctcctcactcagggcacagggtcctgggcccgagtctgccctgactcagcctgcctccgtgtctgggtctcccgggcagtcggtcaccatctcttgcgctggatccagcgatgatattggacgttttaaccttgtctcctggtatcaacaacaccaggacaaagccccaaactcttaatttctggcgtcaatcagcgaccctcacatgtttccagtcgattctctgcatccaagtctggcaacacggcctttctgacaatctctcaactccaggctgaagacgaggctatttattactgctcctcatacgcaggtggcacatttttctggtttttggcggcgggacccagatgactgtcctcagtcagcccaaggctgccccctggt

SEQ ID NO: 557182 - DNA, 496 bp, Homo sapiens
  misc_feature: HIJSMM301BDQHD.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggtattttgcagtgtattactgtcagcagtatcataggtacaaacaccttcggccaagggacacgactggagattaaaggaactgtggctgcaccatctgtcttcatcttccccg

SEQ ID NO: 557183 - DNA, 484 bp, Homo sapiens
  misc_feature: HIJSMM301AHDHF.26.45.E01.1.454.light.4.raw
agactatactcacgaccggtgctcgatttagtgagtcagtaagggaaaggggtgatcaggactcctcagttcaccttctcacaatgatgctccctgctcagctcctggggctgctaatgctctgggtctctggatccagtggagatattgtgatggctcagtctccactctccctgcccgtcacccctggagagccggcctccatctcctgcaggtctagtcagagcgtcctgcatagtagtggatacaactatttggattggtacctgcagaagccagggcagtctccacagctcctgatctatttggcttctaatcgggcctccggggtccctgacaggttcagtggcagtggatcagacacagattttacactgaaaatcagtagagtggaggctgaggatgttggagtttattactgcatgcaagctctacaaactcctctcactttcggcggagggaccgaaggtggagatcaaacgaa

SEQ ID NO: 557184 - DNA, 488 bp, Homo sapiens; identical to SEQ ID NO: 535081
  misc_feature: HIJSMM301EHSS5.26.23.C01.1.454.light.4.raw

SEQ ID NO: 557185 - DNA, 485 bp, Homo sapiens; identical to SEQ ID NO: 538956
  misc_feature: HIJSMM301DU3VZ.40.69.G03.1.454.light.4.raw

SEQ ID NO: 557186 - DNA, 494 bp, Homo sapiens
  misc_feature: HIJSMM301ALNAZ.51.29.C07.1.454.light.4.raw
cgatcgtatacacgaccggtgctcgatttagagtgctacgaagggaaaggggggaactgctcagtcaggacccagacggaaccatggaagccccagcgcagcttctcttcctcctgctactctggctcccagatactactggagaaatagtgatgacgcagtctccagccacgctgtctgtgtctccaggggaaagagccaccctctcctgcagggccagtcagagtgttaacaacaacttagcctggtatcagcagaaacctggccaggctcccaggctcctcatctttggatcatccatcagggccactggtgtcccagaaaagttcagtggcggtgggtctgacacagagtacaccctcaccatcagcaccctgcagtctgaagatgtcgcagtttattactgtcaacaatatagtgacaggtcgccatggacgttcggccaagggaccaaggtggaaatgaaaggaactgtggctgcaccatctgtcttc

SEQ ID NO: 557187 - DNA, 516 bp, Homo sapiens
  misc_feature: HIJSMM301CW4Z8.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgtcgtccgaacggaccgaacggtaggaaggtacaaacgaactagtggcgtgcaccatctgtcttctactcttcccgtccact

SEQ ID NO: 557188 - DNA, 492 bp, Homo sapiens
  misc_feature: HIJSMM301EDAW8.7.85.H08.1.454.light.4.raw
cgtgtctctacacgaccggtgctcgatttagtatcactcagtcgcggggtccaaacagagcttcagcaaacatagtgggaatctgcaccatgccctgggctctgctcctcctgaccctcctcactcactctgcagtgtcagtggtccaggcagggctgactcagccaccctcggtgtccaagggcctgcgacagaccgcaacactcacctgcactgggagcagcaacgatgttggcagggagggagcagcttggctgcagcaacacgagggccaccctcccaaactcctctcctacaggaataacgagcggccctcagggatctcagagagattctctgcatccaggtcaggaaacacagcctccctgaccattactggactccagcctgaggacgaggctgactattactgctcagcagtgggacagcggcctcaggtacttatgtcttcggaactcgggaccctacgttaccgtcctaggtcacgacccg

SEQ ID NO: 557189 - DNA, 444 bp, Homo sapiens; identical to SEQ ID NO: 535027
  misc_feature: HIJSMM301BAFPP.8.73.G07.1.454.light.4.raw

SEQ ID NO: 557190 - DNA, 512 bp, Homo sapiens
  misc_feature: HIJSMM301CMXJ8.40.33.C11.1.454.light.4.raw
tctagcgactcacgaccggtgctcgatttagagtgagctcgttgggtttgggggaaaaggccctgaggaaaacaaaccccagctgggaagcctgagaacacttagccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagaccccaggccagcctccacgttcactcatcgtcagcacaagcagacgtttgcctggggtgcctgatcgcttctctgcctccatccttgggaacaaagctgccctcaccattacgggggcccagccagaggatgagtcttattattactgcatgctccatgtggggggtgccacttgggtgttcggcgggagggaccaagctgaccgtccg

SEQ ID NO: 557191 - DNA, 485 bp, Homo sapiens
  misc_feature: HIJSMM301ENKLV.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacatagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacaggctgcccccaaccttcggccaggggacacgactggagattaaacgaactgtggctgcaccatctgt

SEQ ID NO: 557192 - DNA, 502 bp, Homo sapiens; identical to SEQ ID NO: 541971
  misc_feature: HIJSMM301DR0K3.4.39.D06.1.454.light.4.raw

SEQ ID NO: 557193 - DNA, 505 bp, Homo sapiens; identical to SEQ ID NO: 536254
  misc_feature: HIJSMM301CT3UU.7.71.G05.1.454.light.4.raw

SEQ ID NO: 557194 - DNA, 498 bp, Homo sapiens; identical to SEQ ID NO: 546411
  misc_feature: HIJSMM301E1IC3.48.59.F04.1.454.light.4.raw

SEQ ID NO: 557195 - DNA, 483 bp, Homo sapiens
  misc_feature: HIJSMM301B6OV4.13.36.D03.1.454.light.4.raw
tcacgtactacacgaccggtgctcgatttagctgcgtcacgatctctcttggggggtcagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggctcccaggctcctcatttatggtgcatccactagggccactggtgtcccagtcaggttcagcggcagtgggtctgggacagacttcactctcaccatcagcagcctgcagtctgaagatttgcagtctattactgtcagcagtatagttactggagaaccttcggccaagggacacgactggagattaaaggaa

SEQ ID NO: 557196 - DNA, 488 bp, Homo sapiens
  misc_feature: HIJSMM301ELF7J.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagtattttacactagaaaatcagcagagtggaggctgaggatggttgggctctattattgcatgcaagctctacaagtcccgctcactttcggcggagggaccaaggtggagatacaaacgaa

SEQ ID NO: 557197 - DNA, 504 bp, Homo sapiens; identical to SEQ ID NO: 539083
  misc_feature: HIJSMM301C5XS0.8.19.B08.1.454.light.4.raw

SEQ ID NO: 557198 - DNA, 468 bp, Homo sapiens
  misc_feature: HIJSMM301EQNS9.19.71.G05.1.454.light.4.raw
  modified_base (427)..(427): a, c, t, g, unknown or other
  modified_base (432)..(432): a, c, t, g, unknown or other
tactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaaggctgaagatgtggcgagttattattattnacaanaatattatatatgtagtgtcgacgacgacgagagag

SEQ ID NO: 557199 - DNA, 445 bp, Homo sapiens
  misc_feature: HIJSMM301AUZ6N.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggccccttgacaacagtttgggtgtttgggtgttcggcggagggaccaagctgaccgtcctaagtcagcccaaggctgccccctcggtcattctgttcccgccctcctccgtgtctgat

SEQ ID NO: 557200 - DNA, 515 bp, Homo sapiens
  misc_feature: HIJSMM301CI591.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcgagcctgtgggcaggtcagcccaaggccaacccactgtcactctcg

SEQ ID NO: 557201 - DNA, 504 bp, Homo sapiens; identical to SEQ ID NO: 535128
  misc_feature: HIJSMM301ARSAY.19.85.H08.1.454.light.4.raw

SEQ ID NO: 557202 - DNA, 487 bp, Homo sapiens; identical to SEQ ID NO: 536206
  misc_feature: HIJSMM301EK6XA.47.38.D05.1.454.light.4.raw

SEQ ID NO: 557203 - DNA, 521 bp, Homo sapiens; identical to SEQ ID NO: 538715
  misc_feature: HIJSMM301DUJ80.27.23.C01.1.454.light.4.raw

SEQ ID NO: 557204 - DNA, 497 bp, Homo sapiens; identical to SEQ ID NO: 545672
  misc_feature: HIJSMM301EJUCY.2.49.E05.1.454.light.4.raw

SEQ ID NO: 557205 - DNA, 500 bp, Homo sapiens
  misc_feature: HIJSMM301AKJ83.48.19.B08.1.454.light.4.raw
agtatacatacacgaccggtgctcgatttagtgagtcagtaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcacctcatatacaagcagcagcactctcgtggtattcggcggagggaccaagctgaccgtcctaggtcagcccaaggctgccccctc

SEQ ID NO: 557206 - DNA, 516 bp, Homo sapiens
  misc_feature: HIJSMM301AXMKH.8.87.H10.1.454.light.4.raw
ctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagtgtcagtggccctgggacagacggccagaattacctgtggaggagtcaacattgggacttcagatgtgcactggtaccagcagaagccaggccaggcccctgtactggtcatctttagcgattccaaccggccctctgggatccctgagcgattctctggctccaagtcggggaacacggccaccctgaccatcagcagggcccaacccttggatgagggtgactatttctgtcaagtgtgggacaccaacacttgtgtcttcgggactgggaccgaggtcaccgtcctaagtcagcccagggccaacccactgtcactctgttccaccctcctcgacacg

SEQ ID NO: 557207 - DNA, 516 bp, Homo sapiens
  misc_feature: HIJSMM301CIHUD.3.87.H10.1.454.light.4.raw
agacgcactccacgaccggtgctcgatttagcagtactgcgttgggtttggggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggatccaccggtgacgttgctacttataagtttgtctcctggtcctggtaccaaaaacacccaggcaaagcccccagattaatgatttatgatgtcagtgatcggccctcaggggtttctcatcgcttttctggctccaagtctggcaacacggcctccctgaccatctctgggctccaggctgaggacgaggctgattatttctgcagctcatacacaaccggcaccactgtcgtggttttcggtggagggaccaagctgaccgtctaggtcagccaaggctgccccctcggtcactt

SEQ ID NO: 557208 - DNA, 354 bp, Homo sapiens; identical to SEQ ID NO: 540485
  misc_feature: HIJSMM301E1SQN.40.9.A09.1.454.light.4.raw

SEQ ID NO: 557209 - DNA, 522 bp, Homo sapiens
  misc_feature: HIJSMM301BVJE8.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgacccatctccgggctccagcctgaggacgaggctgattattattgtagttcatatacaaccagtgacacttgggtgttcggcggagggaccaggctgaccgtcctaggtcagccaacggctgccccctcggtcactctgttcccgccct

SEQ ID NO: 557210 - DNA, 486 bp, Homo sapiens; identical to SEQ ID NO: 535385
  misc_feature: HIJSMM301E2JMZ.19.71.G05.1.454.light.4.raw

SEQ ID NO: 557211 - DNA, 491 bp, Homo sapiens; identical to SEQ ID NO: 535194
  misc_feature: HIJSMM301B58QN.26.78.H01.1.454.light.4.raw

SEQ ID NO: 557212 - DNA, 501 bp, Homo sapiens; identical to SEQ ID NO: 538461
  misc_feature: HIJSMM301ANCJX.13.11.A11.1.454.light.4.raw

SEQ ID NO: 557213 - DNA, 377 bp, Homo sapiens; identical to SEQ ID NO: 536071
  misc_feature: HIJSMM301D46T4.40.9.A09.1.454.light.4.raw

SEQ ID NO: 557214 - DNA, 508 bp, Homo sapiens
  misc_feature: HIJSMM301EOV9O.17.33.C11.1.454.light.4.raw
  modified_base (467)..(467): a, c, t, g, unknown or other
cgtagactagcacgaccggtgctcgatttagagtgagctcgttggggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtnttaagtcagcccaaggctgccccctggtcactctgttccca

SEQ ID NO: 557215 - DNA, 489 bp, Homo sapiens; identical to SEQ ID NO: 536663
  misc_feature: HIJSMM301CQQAU.16.72.G06.1.454.light.4.raw

SEQ ID NO: 557216 - DNA, 449 bp, Homo sapiens
  misc_feature: HIJSMM301B6XIA.13.76.G10.1.454.light.4.raw
tcacgtactacacgaccggtgctcgatttagtcactcatacagggcacaggatcctgggctcagtctgccctgactcagcctcgctcagtgtccgggtctcctggacagtcagtcaccatctcctgcactggaagcaacagtgatattggtggttatacctatgtctcctggtaccaacagcacccaggcaaagcccccaaactcattatttatgatttcactaagcgaccctcaggggtccctgatcgcttctctggctccaagtctggcaacacggcctccctgaccatctctgggctccaggctgacgatgaggctgagtattcctgctgctcatctggaggcacctactctttaatattcggcggagggacccagctgaccgtcctaggtcagcccaaggctgccccctcggtcactctgttccccaccctcctctagtacgtga

SEQ ID NO: 557217 - DNA, 490 bp, Homo sapiens
  misc_feature: HIJSMM301B3M5F.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcaccgtcctaggtcagcccaaggccaacccactcg

SEQ ID NO: 557218 - DNA, 486 bp, Homo sapiens; identical to SEQ ID NO: 535043
  misc_feature: HIJSMM301DQ9YA.46.35.D02.1.454.light.4.raw

SEQ ID NO: 557219 - DNA, 487 bp, Homo sapiens; identical to SEQ ID NO: 537220
  misc_feature: HIJSMM301DFKDH.16.53.E09.1.454.light.4.raw

SEQ ID NO: 557220 - DNA, 485 bp, Homo sapiens; identical to SEQ ID NO: 536040
  misc_feature: HIJSMM301CBMCW.15.1.A01.1.454.light.4.raw

SEQ ID NO: 557221 - DNA, 481 bp, Homo sapiens; identical to SEQ ID NO: 535993
  misc_feature: HIJSMM301AFQDW.21.25.C03.1.454.light.4.raw

SEQ ID NO: 557222 - DNA, 521 bp, Homo sapiens
  misc_feature: HIJSMM301CX9T7.41.19.B08.1.454.light.4.raw
tctatactatcacgaccggtgctcgatttagtgagtcagtaagggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggcccaaccccactgtcactctgttcccaccctcct

SEQ ID NO: 557223 - DNA, 496 bp, Homo sapiens
  misc_feature: HIJSMM301AD3GJ.16.6.A06.1.454.light.4.raw
tgtactactccacgaccggtgctcgatttagatctactgacagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagcttggtaccagcagaaaccggggcagtctcctaagttgctcatttactgggcgtctacccgggaatccggggtccctgaccgattcagtggcagcgggtctgggacagatttcactctcaccatcagcagcctgcaggttgaagatgtggcagtttatactgtcagcagtattatactactcctctgacgttcggccaagggaccaaggtgggagatcaaacgaaactgtggcgtgcaccat

SEQ ID NO: 557224 - DNA, 486 bp, Homo sapiens; identical to SEQ ID NO: 537583
  misc_feature: HIJSMM301AQPW4.17.25.C03.1.454.light.4.raw

SEQ ID NO: 557225 - DNA, 488 bp, Homo sapiens
  misc_feature: HIJSMM301BXE63.19.71.G05.1.454.light.4.raw
  modified_base (420)..(420): a, c, t, g, unknown or other
tactctcgtgcacgaccggtgctcgatttagtgtcgtcgcaagagagaggggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttnttattgtcaacaatattattatacttcgtggacgttcggccaagggaccaaggtggatatcagacgaa

SEQ ID NO: 557226 - DNA, 516 bp, Homo sapiens
  misc_feature: HIJSMM301AKU06.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcgggcgttcggtccgaacgggaccgaaggtagggaaattacaaaacgaactacgtggcgtgcaccatctgtcttctatcttccccg

SEQ ID NO: 557227 - DNA, 454 bp, Homo sapiens; identical to SEQ ID NO: 534964
  misc_feature: HIJSMM301EXOI6.19.86.H09.1.454.light.4.raw

SEQ ID NO: 557228 - DNA, 486 bp, Homo sapiens; identical to SEQ ID NO: 535043
  misc_feature: HIJSMM301CL6JO.46.35.D02.1.454.light.4.raw

SEQ ID NO: 557229 - DNA, 443 bp, Homo sapiens
  misc_feature: HIJSMM301BMQW4.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctcgccccctcggtcactctcgttcccaccctcctcgtatctctcg

SEQ ID NO: 557230 - DNA, 504 bp, Homo sapiens
  misc_feature: HIJSMM301EZ7LZ.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaaagcccccaaactccatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaaccca

SEQ ID NO: 557231 - DNA, 496 bp, Homo sapiens
  misc_feature: HIJSMM301D832D.26.80.H03.1.454.light.4.raw
agactatactcacgaccggtgctcgatttagctgtgcgtcgaagggaaagggactgactaccacctgcaggtcagggccaaggttatggggtcccaggttcacctcctcagcttcctcctcctttggatctctgagccgacactcacgcagtctccagcattcatgtcagcgactctaggagacaaggtcaacttctcctccaaagccagccaagacattgatgatgatatgaactggcaccaacacaaaccaggagaagctgctatttccattactcaagaactaatggtctcctacctggaatgccacctcgactcagtggcaacaaatatggaacagtttttaccctcacaactcatatcacagaatctgaggatgctgcattttacttcggtctacaacatgataatttccctccgtggacgttcggccaagggaccaaggagcaaatcaaacgaactgtggctgcaccatctgtcttcatcttcccgccat

SEQ ID NO: 557232 - DNA, 461 bp, Homo sapiens; identical to SEQ ID NO: 536110
  misc_feature: HIJSMM301DKXNC.4.39.D06.1.454.light.4.raw

SEQ ID NO: 557233 - DNA, 499 bp, Homo sapiens
  misc_feature: HIJSMM301CFTDT.12.18.B07.1.454.light.4.raw
atacgacgtacacgaccggtgctcgatttagtcgctgcgtaagggggaggaactgctcagttaggacccagagggaaccatggaagccccagctcagcttctcttcctcctgctactctggctcccagataccaccggagaaattgtgttgactcagtctccagccaccctgtctttgtctccaggggaaagagcaaccctctcctgcagggccagtcagagtgttaacagatacttagcctggtaccagcagagacctggccaggctcccaggctcctcatctatgatacattgaagagggccactggcatctcaggcagattcaatggcagtgggtctgggacagacttcactctcaccctcaccagcctagagcctgaagattttggaatttattactgtcaacagcgtagcaactggcctcccactttcggcggagggaccaaggtggagatcaagcgaactgtggctgcaccatctgtcttcatcttcccgcca

SEQ ID NO: 557234 - DNA, 486 bp, Homo sapiens; identical to SEQ ID NO: 535385
  misc_feature: HIJSMM301DYAZ6.19.71.G05.1.454.light.4.raw

SEQ ID NO: 557235 - DNA, 490 bp, Homo sapiens
  misc_feature: HIJSMM301BO0WK.17.25.C03.1.454.light.4.raw
cgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacagatttcaatctcaccatcaccactctgcaacctgaggattgtgcaatctactactgtcaacagagttacagttcccctcgcacttttggccaggggaccaaagttgagatcaaacgaaactgtggctgcaccatctgtt

SEQ ID NO: 557236 - DNA, 495 bp, Homo sapiens; identical to SEQ ID NO: 543631
  misc_feature: HIJSMM301DYRUL.11.59.F04.1.454.light.4.raw

SEQ ID NO: 557237 - DNA, 514 bp, Homo sapiens
  misc_feature: HIJSMM301DGVE1.49.25.C03.1.454.light.4.raw
agtcgagagacacgaccggtgctcgatttagtagtgtagatttgggtttgggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgccaaaaagatatgcttattggtaccatcagaagtcaggccaggcccctgtactggtcatctatgaggacaccaaacgaccctccgggatccctacgagattctctggctccagtttagggacagtggccaccctgacagtcagtggggcccaggtggaggatgagggtgattactactgttactcaacagacattactactactcatagggtgttcggcggagggaccaagctgaccgtctaggtcagcccaaggctgccccctcggtcactctgttcccgccctcct

SEQ ID NO: 557238 - DNA, 479 bp, Homo sapiens; identical to SEQ ID NO: 536050
  misc_feature: HIJSMM301CHGVD.5.73.G07.1.454.light.4.raw

SEQ ID NO: 557239 - DNA, 466 bp, Homo sapiens
  misc_feature: HIJSMM301EQKQY.13.4.A04.1.454.light.4.raw
tcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacacagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacaggggtcccatcaaggttcagtggaagtggatctgggacagattttattttcaccatcagcagcctgcagcctgaagatattgcaacatattactgtcagcagtatgataatctcccgatcaccttcggccaagggacacgactggagattaaacgaa

SEQ ID NO: 557240 - DNA, 490 bp, Homo sapiens
  misc_feature: HIJSMM301AIFZN.14.56.F01.1.454.light.4.raw
cgtctagtaccacgaccggtgctcgatttagcagacgtctgaacacacaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgttaatttcggttggagggaccaaggtggaggtcaaacgaactagtggctgcacatctgtt

SEQ ID NO: 557241 - DNA, 420 bp, Homo sapiens
  misc_feature: HIJSMM301C88B3.18.78.H01.1.454.light.4.raw
tacgagtatgcacgaccggtgctcgatttagtgtgagtagtttgggtttggggctttgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaaccctctgtcactctgttcccaccctcctccatactcgta

SEQ ID NO: 557242 - DNA, 494 bp, Homo sapiens; identical to SEQ ID NO: 534994
  misc_feature: HIJSMM301C212S.27.78.H01.1.454.light.4.raw

SEQ ID NO: 557243 - DNA, 504 bp, Homo sapiens
  misc_feature: HIJSMM301BXZQO.48.15.B04.1.454.light.4.raw
agtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgttttttcacacctccatgaacaaggagtacttggcttggttccagcagaaaccagggcagcctcctaaactactcatttactcggcatccacccggaagtccgaggttcctgaccgattccgtggcagcgggtctgggacagattttactctcaccatcactaccctgcaggctgaagatgtggcagtttatactgtcaacaatattattctactccgccgacgttcgccggggaccaacgtggaaatcaaacgaactgtggctgcaccatctgtcttc

SEQ ID NO: 557244 - DNA, 460 bp, Homo sapiens; identical to SEQ ID NO: 536053
  misc_feature: HIJSMM301DWKKK.22.28.C06.1.454.light.4.raw

SEQ ID NO: 557245 - DNA, 483 bp, Homo sapiens
  misc_feature: HIJSMM301A824G.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtccaagaacttttggccagggaccaagctggagatcaacgaactgtggctgcaccat

SEQ ID NO: 557246 - DNA, 487 bp, Homo sapiens
  misc_feature: HIJSMM301A2KDS.51.29.C07.1.454.light.4.raw
cgatcgtatacacgaccggtgctcgatttagagtgctacgaagggaaagggggaatcagtcccactcaggacacagcatggacatgagggtccccgctcagctcctggggctcctgctgctctggttcccaggtcccaggtgtgacatccagatgacccagtctccaccctccctgtctgcttctgtacgagacagagtcaccatcacttgccggacaagtcagggcactagaagttctttaggctcctttcagcagagaccagggaaagcccctacgcgccttaactatgttacattcagtttgcaaagtggcgtcccatcaaggtccagcggcattggatctggggcagaattcactctcacattcagcagcctgcagcctgaagatttttcaacttataagtgtctacatcataattcttggaggagatcacacgttggaactgtggctgcaccatctgtcttcatcttcccgcatctgatcgt

SEQ ID NO: 557247 - DNA, 503 bp, Homo sapiens; identical to SEQ ID NO: 536313
  misc_feature: HIJSMM301BINU9.21.22.B11.1.454.light.4.raw

SEQ ID NO: 557248 - DNA, 484 bp, Homo sapiens; identical to SEQ ID NO: 535400
  misc_feature: HIJSMM301DAMQ8.46.26.C04.1.454.light.4.raw

SEQ ID NO: 557249 - DNA, 486 bp, Homo sapiens
  misc_feature: HIJSMM301C202P.48.10.A10.1.454.light.4.raw
agtatacatacacgaccggtgctcgatttagcgtcgatctcaggggagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggaccttcggtccaagggaccacgggtggaaatcaaacgaactagtggctgcaccatctgtcttcatt

SEQ ID NO: 557250 - DNA, 441 bp, Homo sapiens
  misc_feature: HIJSMM301EAB6N.18.9.A09.1.454.light.4.raw
tacgagtatgcacgaccggtgctcgatttagcgagacgcgcagggtcctgggcccagtctgtgctgacgcagccgccctcagtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccactgtcactctgttcccgccctcctccatactcgta

SEQ ID NO: 557251 - DNA, 503 bp, Homo sapiens
  misc_feature: HIJSMM301DW1YO.48.36.D03.1.454.light.4.raw
agtatacatacacgaccggtgctcgatttagctgcgtcacgatctctcttggggggggtcgtcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcggggtccctgatcgcttctctggctccaagtctggcaacacggcctccctgaccatctctgggctccaggctgaagatcaggctgattattactgctgttcattttcaagttcctttttgtcttcggaactgggaccgaggtcaccgtcctaggtcagcccaaggccaacccactgtcta

SEQ ID NO: 557252 - DNA, 487 bp, Homo sapiens
  misc_feature: HIJSMM301B6IMO.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctggggacagacttcactctcaccatcagcagactggagcctgaagattttgcagtctattactgtcagcagtatggtcacgtcccaagaacttttggccaggggaccaagctggagatcaaacgaactgtggctgcaccat

SEQ ID NO: 557253 - DNA, 495 bp, Homo sapiens
  misc_feature: HIJSMM301B8DOM.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtctaggtcagcccaag

SEQ ID NO: 557254 - DNA, 489 bp, Homo sapiens; identical to SEQ ID NO: 535139
  misc_feature: HIJSMM301CJZBI.14.55.E11.1.454.light.4.raw

SEQ ID NO: 557255 - DNA, 511 bp, Homo sapiens
  misc_feature: HIJSMM301CS3HQ.40.12.B01.1.454.light.4.raw
tctagcgactcacgaccggtgctcgatttagtagtgtagattccgcggggtggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaactacacccaggcaaagcccccaaactcatgatttctgacgtcagtaagcggccctcaggggtccctgatcgcttctctggctccaagtctggcaacacggcctccctgaccgtctctgggctccaggctgaagatgaggctgattattactgctactcgtatgcaggcggcaacaattgggtcttcggcggagggaccaagctgaccgtcctaggtcagcccaaggctgccccctcggtcactctgtt

SEQ ID NO: 557256 - DNA, 501 bp, Homo sapiens; identical to SEQ ID NO: 544375
  misc_feature: HIJSMM301BAHJB.21.8.A08.1.454.light.4.raw

SEQ ID NO: 557257 - DNA, 508 bp, Homo sapiens
  misc_feature: HIJSMM301DKJSI.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaactagttttctcgggcgttcggccaagggaccaaggtggaaatacgaaacgaacctagtggctgcaccatctgtcttcactcttccccg

SEQ ID NO: 557258 - DNA, 487 bp, Homo sapiens; identical to SEQ ID NO: 537220
  misc_feature: HIJSMM301B6YFX.16.53.E09.1.454.light.4.raw

SEQ ID NO: 557259 - DNA, 512 bp, Homo sapiens
  misc_feature: HIJSMM301AJSTR.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgtcgtccaggaccgaacggtaggaagtacaagacgaacgtacgtaggcgtgcaccactctgtcttctactcttcccgt

SEQ ID NO: 557260 - DNA, 507 bp, Homo sapiens
  misc_feature: HIJSMM301AOGRM.12.53.E09.1.454.light.4.raw
atacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggaggggaccaagctgaccgtcctgggtcagcccaaggctgcccctccggtcactctgttcccgccctcctctaccgtcgtat

SEQ ID NO: 557261 - DNA, 520 bp, Homo sapiens; identical to SEQ ID NO: 539176
  misc_feature: HIJSMM301C1IGY.27.23.C01.1.454.light.4.raw

SEQ ID NO: 557262 - DNA, 519 bp, Homo sapiens
  misc_feature: HIJSMM301B482C.53.65.F10.1.454.light.4.raw
cgcgtatacacacgaccggtgctcgatttagctacgctctaaggggctgggcctaaggaagcagcactggtggtgcctcagccatggcctggaccgttctcctcctcggcctcctctctcactgcacagactctgtgacctcctatgtgctgactcagccaacctcggtgtcagtggccccaggacagacggccagcattacctgtgggggaaaccacattggagctaaaaatgtgcactggtaccagcagaagccaggccaggcccctgtgctggtcgtctataatggaagcggccggccctcatggatccctgggcgattctctggctccaagtctgggaacacggccaccctaaccatcagcagggtcgaagccggggatgaggccgactattactgtcaggtgtgggataatagtaatggtgggaagttgggtgttcggcggagggaccaagctgaccgtcctaggtcagcccaaggctgccccctcggtcactctgttcccgccctcctctcgt

SEQ ID NO: 557263 - DNA, 476 bp, Homo sapiens
  misc_feature: HIJSMM301DAM4D.43.76.G10.1.454.light.4.raw
tgtgagtagtcacgaccggtgctcgatttagtcactcatacaggggactgcgggggtaagaggttgtgtccaccatggcctggactcctctcctcctcctgttcctctctcactgcacaggttccctctcgcaggctgtgctgactcagccgtcttccctctctgcatctcctggagcatcagccagtctcacctgcaccttgcgcagtggcatcaatgttgctacccacacaatatactggtaccagcagaagtcagggagtcctccccagtttctcctgaggtacaaatcagactcagataagcagcagggctctggaatccccagccgcttctctggatccaaggatgcttcggccaatgcaggaattttgctcatctctgggctccagtctgaggatgaggctgactattactgtacgatttggcacaacgacgctgtggttttcggcggagggaccaaggctgaccgtcct

SEQ ID NO: 557264 - DNA, 454 bp, Homo sapiens; identical to SEQ ID NO: 536347
  misc_feature: HIJSMM301AYJ9B.19.86.H09.1.454.light.4.raw

SEQ ID NO: 557265 - DNA, 474 bp, Homo sapiens
  misc_feature: HIJSMM301ES87P.12.49.E05.1.454.light.4.raw
atacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagcaattttttagcctggtatcagcagaaaccagggaaagttccacacctcctgatctatgctgcatccgctttgcaatcaggggtcccatctcggttcagcggcagtggatctgggacagagttcactctcaccatcagcagcctgcagcctgaagatgttgcaacttattactgtcaaaagtataacagtgccccccttcaccttcggccaagggacacgactggagattagacg

SEQ ID NO: 557266 - DNA, 560 bp, Homo sapiens
  misc_feature: HIJSMM301EULVL.15.78.H01.1.454.light.4.raw
  modified_base (521)..(521): a, c, t, g, unknown or other
tctacgtagccacgaccggtgctcgatttagtgtgagtagtttgggtttggggtacgatttgtatgttacctgatgcttagaggcttttccttggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgtttcccatcgactacgcctttcggcctcgccttaggggtcgactcaccctgccccgattaacgttggacaggaacccttggtcttccggcgagcgggcttttcacccgctttatcgttacttatgtcagcattcgcacttctgatacctccagcatgcctcacagcacaccttcacaggcttacagaacgctccccctacccaacaacgcataagcgtcgctgccgcagcttcggtgcatggttttancccccgttttcatcttccccgccatctgagctacgtaga

SEQ ID NO: 557267 - DNA, 481 bp, Homo sapiens
  misc_feature: HIJSMM301APPDY.7.83.H06.1.454.light.4.raw
cgtgtctctacacgaccggtgctcgatttagatcacgtgcgtcgcggggctccaaacagagcttcagcaagcatagtgggaatctgcaccatgcccggggctctgctcctcctgaccctcctcactcactctgcagtgtcagtggtccaggcagggctgactcagccgccctcggtgtccaagggcttggggcagaccgccacactcacctgcactgggaacagcaacaatgttggcgaccaaggagcagcttggctgcagcagcaccagggccaccctcccaaactcctatcctacaggaataacaaccggccctcagggatctcggagagattctctgcatccaggtcaggatacacagcctccctgacccattactggactccagcctgaggacgaggctgactattactgctcagcatgggacagcagcctccgtggtgtggtgatcggcggagggaccaggctgaccgtcctaggt

SEQ ID NO: 557268 - DNA, 491 bp, Homo sapiens; identical to SEQ ID NO: 535194
  misc_feature: HIJSMM301C9HS2.26.78.H01.1.454.light.4.raw

SEQ ID NO: 557269 - DNA, 484 bp, Homo sapiens; identical to SEQ ID NO: 535240
  misc_feature: HIJSMM301EAZ2U.47.60.F05.1.454.light.4.raw

SEQ ID NO: 557270 - DNA, 516 bp, Homo sapiens
  misc_feature: HIJSMM301CUEHQ.9.2.A02.1.454.light.4.raw
tgatacgtctcacgaccggtgctcgatttagactcatctacaggggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacgaatagcgacattggtggctctaatcatgtctcctggtactataacagtccaggcaaagcccccaaactcataatttatgatgtctttagacggccctcagggatttcttctcggttgtctggctccaagtctgggaacacggcctccctgaccatctctggacttcagcctgaggacgagggtgattacttctgcagttcagattcagaaacttcccctcgttggtgttcggcggagggaccatgctgaccgtcctgagtcagccaaggctcgccccctcggtcactctgttcccaccct

SEQ ID NO: 557271 - DNA, 484 bp, Homo sapiens; identical to SEQ ID NO: 536162
  misc_feature: HIJSMM301AVYBX.13.59.F04.1.454.light.4.raw

SEQ ID NO: 557272 - DNA, 504 bp, Homo sapiens; identical to SEQ ID NO: 556745
  misc_feature: HIJSMM301BOSOC.16.49.E05.1.454.light.4.raw

SEQ ID NO: 557273 - DNA, 441 bp, Homo sapiens; identical to SEQ ID NO: 535074
  misc_feature: HIJSMM301ALJL0.11.3.A03.1.454.light.4.raw

SEQ ID NO: 557274 - DNA, 489 bp, Homo sapiens
  misc_feature: HIJSMM301DIXZF.15.1.A01.1.454.light.4.raw
tctacgtagccacgaccggtgctcgatttagacgtctcatcagggcctgggctctgctgctcctcactcctcctcactcaggacacagggtcctgggcccagtctcgccctgactcagcctgcctccgtgtctgggtctcctggacagtcgatcaccatctcctgcactggaaccagcagtgatgttgggggttatcaccttgtctcctggtaccaacaccaccccggcacgggcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcacgcccaaggctgccccctcggtcactctgttcccacctccctcgctacgtaga

SEQ ID NO: 557275 - DNA, 521 bp, Homo sapiens
  misc_feature: HIJSMM301B9FG8.40.27.C05.1.454.light.4.raw
tctagcgactcacgaccggtgctcgatttagacgcgatcgaagggtttgggggggaagctcagcttcagctgtggtggagaagacaggattcaggccaatctccagcatggccggcttccctctcctcctcaccctcctcactcactgtgcagggtcctgggcccagtctgtgctgactcagccaccctcagcgtctgagacccccgggcagcaggttaccgtctcttgttctggaagcagctccaacatcggaagtaattctgtatactggtaccagtgcctcccaggaacggcccccaaacttctcgtctatagggattatcagcggcccttaggggtccctgaccgattctctggctccaggtctggcacctcagcctccctggccatcagtgggctccggcccgaggatgaggcggattattattgtgtgtcatgggatgacagaatgaatggtccggtggttcggcggagggaccaggctgaccgtcctaggtcagcccaaggctcgcccctcggt

SEQ ID NO: 557276 - DNA, 508 bp, Homo sapiens; identical to SEQ ID NO: 550253
  misc_feature: HIJSMM301BH7K4.9.55.E11.1.454.light.4.raw

SEQ ID NO: 557277 - DNA, 495 bp, Homo sapiens; identical to SEQ ID NO: 538269
  misc_feature: HIJSMM301A6ZI1.9.1.A01.1.454.light.4.raw

SEQ ID NO: 557278 - DNA, 516 bp, Homo sapiens; identical to SEQ ID NO: 538293
  misc_feature: HIJSMM301AUGMN.14.19.B08.1.454.light.4.raw

SEQ ID NO: 557279 - DNA, 515 bp, Homo sapiens
  misc_feature: HIJSMM301B4LDE.52.57.F02.1.454.light.4.raw
cgcagtacgacacgaccggtgctcgatttagctcgatatagttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtgcttatgactttgtctcctggtaccaacaccaccctggcaaagcccccaaactcatcatttttgaggtcactaagcggccctcaggggtccctgatcgcttctctggctcgaagtctggcaacacggcctccctgaccgtctctgggctccaggctgaggatgaggctgattactactgcacctcatatgcaggcgacaactaatttgggggttttcggcggagggaccaaggtgaccgtcctacgtcagcccaaggctgccccctcggtcact

SEQ ID NO: 557280 - DNA, 515 bp, Homo sapiens
  misc_feature: HIJSMM301EZARI.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctcggtcactctgttcccgccctcctcgctacgtagac

SEQ ID NO: 557281 - DNA, 474 bp, Homo sapiens
  misc_feature: HIJSMM301CA446.51.76.G10.1.454.light.4.raw
cgatcgtatacacgaccggtgctcgatttagtcactcatacaggggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggccactgatatcccagccaggttcagtggcagtgggtctgggacagagttcactctcaccatcagcagcctgcagtctgaagattttgcaattattactgtcagcagtataataactggcctcgtacacttttggccaggggaccaagctggagatcaaacgaactgtggctgcacc

SEQ ID NO: 557282 - DNA, 494 bp, Homo sapiens
  misc_feature: HIJSMM301BHT5L.51.29.C07.1.454.light.4.raw
cgatcgtatacacgaccggtgctcgatttagagtgctacgaagggaaaggggaggaactgctcagtcaggacccagacggaaccatggaagccccagcgcagcttctcttcctcctgctactctggctcccagatactactggagaaatagtgatgacgcagtctccagccacgctgtctgtgtctccaggggaaagagccaccctctcctgcagggccagtcagagtgttaacaacaacttagcctggtatcagcagaaacctggccaggctcccaggctcctcatctttggatcatccatcagggccactggtgtcccagaaaagttcagtggcggtgggtctgacacagagtacaccctcaccatcagcaccctgcagtctgaagatgtcgcagtttattactgtcaacaatatagtgacaggccgccatggacgttcggccaagggaccaaggtggaaatgaaaggaactgtggctgcaccatctgtctt

SEQ ID NO: 557283 - DNA, 515 bp, Homo sapiens
  misc_feature: HIJSMM301CQYOO.52.53.E09.1.454.light.4.raw
  modified_base (502)..(502): a, c, t, g, unknown or other
cgcagtacgacacgaccggtgctcgatttagagagagtgtgttgggtttgggggatcaggactcctcagttcaccttctcacaatgaggctccctgctcagctcctggggctgctaatgctctgggtcccagcatccactggggatgttataatgactcagtctccactctccctgcccgtctcccttggacagccggcctccatctcctgcaggtctagtcaaggcctcgttttcagtgatggaaacacctacttgaattggtttcaccagaggccaggccaacctccaaggcgcctaatttataaggtttctaagcgggactctggggtcccagacagattcagtggcagtgggtcaggcactgatttctcactgcaaatcagcgggtggaggctgaggatgttggggtttattactgcatgcaaggtacacactggcctccgacgttcggccaagggaccaaggtggaaatcaaacgaactgtggctgcaccatctgtnttcatcttccccg

SEQ ID NO: 557284 - DNA, 496 bp, Homo sapiens; identical to SEQ ID NO: 536248
  misc_feature: HIJSMM301D2SHX.22.27.C05.1.454.light.4.raw

SEQ ID NO: 557285 - DNA, 505 bp, Homo sapiens
  misc_feature: HIJSMM301DS4NN.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaagtaggatatcaaacgaactgtggctgcaccatctgtt

SEQ ID NO: 557286 - DNA, 497 bp, Homo sapiens; identical to SEQ ID NO: 535286
  misc_feature: HIJSMM301BRKQR.18.59.F04.1.454.light.4.raw

SEQ ID NO: 557287 - DNA, 500 bp, Homo sapiens
  misc_feature: HIJSMM301C1HV0.22.21.B10.1.454.light.4.raw
acatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccacccaggcacagcccccaaactcatgatttatgaggtcactaagcgggcctcaggggtccctgatcgcttctctggctccaagtctggcgacacggcctccctgaccgtctctgggctccaggctgaggatgaggctgattattactgctactcatatgcaggcggcaactcttgggtgttcggcggagggaccaagctgaccgtcctaggtcagcccaaggctgccccctcggtcact

SEQ ID NO: 557288 - DNA, 479 bp, Homo sapiens; identical to SEQ ID NO: 535118
  misc_feature: HIJSMM301CEI8P.13.59.F04.1.454.light.4.raw

SEQ ID NO: 557289 - DNA, 488 bp, Homo sapiens
  misc_feature: HIJSMM301CJ1QT.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtgggtcccatcaaggttcagcggcagtgggtctgggacagaattcactctcaccatcagcagcctgcaacctgatgactttgcaacttattactgccaacagtataatggttatgaatccacttttggccaagggaccaagctggagatcaaacgaactgtggctgcacca

SEQ ID NO: 557290 - DNA, 468 bp, Homo sapiens
  misc_feature: HIJSMM301CK9LI.49.4.A04.1.454.light.4.raw
agtcgagagacacgaccggtgctcgatttagagtagtgatcaggggcagtcccaaccaggacacagcatggacatgagggtccctgctcagctcctggggctcctgctgctctggctctcaggtgccagatgtgtcatccagatgacccagtctccttcctccctgtctgcatctataggagacagaatcaccatcacttgccgggcgagtcgagacattagcatgtatctgaattggtatcagcaaaaaccagggacagcccctaaactcctgatcctcgatgcatccactttggagacaggggtcccatcaaggttcagtggaagtggctctgggacagattttactttcaccatcagcaggctgcagcctgaagatattgcaacatattactgtcaacagtatgatcgcctcccgctcactttcggcgggggaccaaggtggagatcaagcgaactgtggctgca

SEQ ID NO: 557291 - DNA, 521 bp, Homo sapiens; identical to SEQ ID NO: 539470
  misc_feature: HIJSMM301C0RXX.27.23.C01.1.454.light.4.raw

SEQ ID NO: 557292 - DNA, 507 bp, Homo sapiens; identical to SEQ ID NO: 539082
  misc_feature: HIJSMM301BUUY2.14.7.A07.1.454.light.4.raw

SEQ ID NO: 557293 - DNA, 488 bp, Homo sapiens; identical to SEQ ID NO: 539884
  misc_feature: HIJSMM301EEKYN.7.85.H08.1.454.light.4.raw

SEQ ID NO: 557294 - DNA, 477 bp, Homo sapiens
  misc_feature: HIJSMM301D2266.13.76.G10.1.454.light.4.raw
tcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccgggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtacaggcgtgggacagcagcactgcccgctatgtcttcggaactgggaccaaggtcaccgtcctaagtcagcccaac

SEQ ID NO: 557295 - DNA, 484 bp, Homo sapiens; identical to SEQ ID NO: 535240
  misc_feature: HIJSMM301A056Q.47.60.F05.1.454.light.4.raw

SEQ ID NO: 557296 - DNA, 477 bp, Homo sapiens; identical to SEQ ID NO: 540405
  misc_feature: HIJSMM301B99QP.3.82.H05.1.454.light.4.raw

SEQ ID NO: 557297 - DNA, 405 bp, Homo sapiens
  misc_feature: HIJSMM301EO5NB.7.27.C05.1.454.light.4.raw
cgtgtctctacacgaccggtgctcgatttagacgcgatcgaagggtttggggccccagggcagagggtcaccatctcctgcactgggaacgcctccaacatcgggactttttatgatgcacactggtaccagcgccttccaggaacagcccccaccctcctcattcataataataacattcggccctcaggggtccctgaccgcttctctggctccaagtctggctcctcagcctccctggccatcactgggctccaggctgacgatgagggtgaatattactgccagtcatatgacagcagcctgcgtctttgggtgttcggcggagggaccaagctgaccgtcctacgtcagcccaaggctgccccctcggtcactctgttcccgccctcctctagagacacg

SEQ ID NO: 557298 - DNA, 485 bp, Homo sapiens
  misc_feature: HIJSMM301EO8J6.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccaggtcaccgtcctaggtcagcccaaggccaacccc

SEQ ID NO: 557299 - DNA, 469 bp, Homo sapiens
  misc_feature: HIJSMM301B15NB.13.8.A08.1.454.light.4.raw
tcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggcaagtcagaccattgacaaatatgtaaattggtatcaacagaagccaggtgaagcccctaagctcctgatctatactgcatccactttgtcaggcggggtcccatcaaggttccgtggcagtggatctgggacagatttcactctcaccatcagcagcctgcaggctgaagatgtggcagtttattactgtcagcaatattatagtactcctccgaggctcactttcggcggagggaccaaggtggagatcaaacgaa

SEQ ID NO: 557300 - DNA, 454 bp, Homo sapiens; identical to SEQ ID NO: 534964
  misc_feature: HIJSMM301BL21Y.19.86.H09.1.454.light.4.raw

SEQ ID NO: 557301 - DNA, 517 bp, Homo sapiens
  misc_feature: HIJSMM301CJOOX.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggctgccccctcggtcactctgttcccgcctcctccacg

SEQ ID NO: 557302 - DNA, 493 bp, Homo sapiens
  misc_feature: HIJSMM301ARHZA.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgactatcactggggctcaggcggaagatgaggctgactattactgtaactcccgggccagcagtggtaacattgtgatattcggcggagggaccaaggtgaccgtcctacgtcagcccaaggctgccccctcggtcact

SEQ ID NO: 557303 - DNA, 515 bp, Homo sapiens
  misc_feature: HIJSMM301A5019.12.85.H08.1.454.light.4.raw
atacgacgtacacgaccggtgctcgatttagtatcactcagtcgcggggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcaccatttcctgcaccggaaccaatagtgacgttggtcgttataactttgtctcctggtacaaacagcacccaggcaaagccccccaactcctgatttatgaggtcactattcggtcctcaggaatttctaatcgcttctctggttccaagtctggcaacacggcctccctgaccatctctggggtccaggctgaggacgaggctgattattactgcagttcatatacaagcacttccactctcgtggtgttcggcggtgggaccaagctgaccgtcctaagtcagcccaaggctgccccctggtcactctgttccca

SEQ ID NO: 557304 - DNA, 471 bp, Homo sapiens
  misc_feature: HIJSMM301B23E3.52.8.A08.1.454.light.4.raw
cgcagtacgacacgaccggtgctcgatttagcatactctacaggggagtcccaaccaggacacagcgtggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctcccgctcactttcggcgggggaccgaaggtggaggatcaagcgaactgtggctgcacc

SEQ ID NO: 557305 - DNA, 494 bp, Homo sapiens
  misc_feature: HIJSMM301EPLR7.10.79.H02.1.454.light.4.raw
catagtagtgcacgaccggtgctcgatttagtgtcacacgaagggaaagggggagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggccaggggaccaagctggagatcaaacgaactgtggctgcaccatctgtcttca

SEQ ID NO: 557306 - DNA, 494 bp, Homo sapiens; identical to SEQ ID NO: 536444
  misc_feature: HIJSMM301EH6SW.26.72.G06.1.454.light.4.raw

SEQ ID NO: 557307 - DNA, 354 bp, Homo sapiens; identical to SEQ ID NO: 540485
  misc_feature: HIJSMM301EIP3H.40.9.A09.1.454.light.4.raw

SEQ ID NO: 557308 - DNA, 510 bp, Homo sapiens
  misc_feature: HIJSMM301BG2MF.52.37.D04.1.454.light.4.raw
cgcagtacgacacgaccggtgctcgatttagtagcatactgttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacattggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacagaaacacttgggtgttcggcggcgggaccaaactgaccgtcctacgtcagcccaaggctgccccctcggtcta

SEQ ID NO: 557309 - DNA, 493 bp, Homo sapiens; identical to SEQ ID NO: 536471
  misc_feature: HIJSMM301CXSDG.3.71.G05.1.454.light.4.raw

SEQ ID NO: 557310 - DNA, 508 bp, Homo sapiens
  misc_feature: HIJSMM301CAX65.5.59.F04.1.454.light.4.raw
atcagacacgcacgaccggtgctcgatttagtacacacacttagggattggggagagctgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctgggacagacttcactctcaccatcagcagactggagcctgaagattttgcagtgtattactgtcagcagtatggtagctcacggacgttcggccaagggaccaaggtggaaagtacaaacgaactagtggcgtgcaccactctgtcttctatcttccccg

SEQ ID NO: 557311 - DNA, 485 bp, Homo sapiens; identical to SEQ ID NO: 536040
  misc_feature: HIJSMM301EFQVQ.15.1.A01.1.454.light.4.raw

SEQ ID NO: 557312 - DNA, 503 bp, Homo sapiens
  misc_feature: HIJSMM301AYD1R.51.71.G05.1.454.light.4.raw
cgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgttcttcggaactgcgaccaaggtccaccgtccgtgggtcacggcccaacggcccaacccccatcgtcta

SEQ ID NO: 557313 - DNA, 383 bp, Homo sapiens; identical to SEQ ID NO: 447524
  misc_feature: HIJSMM301EZYBG.41.26.C04.1.454.light.4.raw

SEQ ID NO: 557314 - DNA, 506 bp, Homo sapiens; identical to SEQ ID NO: 534969
  misc_feature: HIJSMM301CQHBL.18.37.D04.1.454.light.4.raw

SEQ ID NO: 557315 - DNA, 493 bp, Homo sapiens
  misc_feature: HIJSMM301B1HOK.13.46.E02.1.454.light.4.raw
tcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatcagcagggtggaggctgaggatgttattgggctctattattgcatgcaagcaacacactggccgtacacttttggccacggggaccaagctggagatcaatcgaactgtgg

SEQ ID NO: 557316 - DNA, 489 bp, Homo sapiens; identical to SEQ ID NO: 539458
  misc_feature: HIJSMM301CP0D8.22.25.C03.1.454.light.4.raw

SEQ ID NO: 557317 - DNA, 501 bp, Homo sapiens
  misc_feature: HIJSMM301BW4BM.51.57.F02.1.454.light.4.raw
cgatcgtatacacgaccggtgctcgatttagctcgatatagttgggtttggggggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataatttggggtctaagtatgtttcgtggtatcaacatcacccaggccggtccccgatactgctcctctatcatgatgccaagcggccctcagggatccctgagcgattctctggctccaactctggggacacagccactctgaccatccgcgggacccaggctgtggatgaggctgactattactgtcaggcgtgggacagggaggctgcgattttcggcggagggaccagtctgaccgtcctaggtcagcccaaggctgccccctcggtcactctgttcccc

SEQ ID NO: 557318 - DNA, 490 bp, Homo sapiens; identical to SEQ ID NO: 535234
  misc_feature: HIJSMM301DO8YC.17.21.B10.1.454.light.4.raw

SEQ ID NO: 557319 - DNA, 506 bp, Homo sapiens
  misc_feature: HIJSMM301EYZDM.8.42.D09.1.454.light.4.raw
ctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcggcggagggaccaagttgaccgtcctaggtcagcccaaggctgccccctcggtcactctgttcccacct

SEQ ID NO: 557320 - DNA, 490 bp, Homo sapiens
  misc_feature: HIJSMM301AUZ08.13.5.A05.1.454.light.4.raw
tcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcgtcggagggaccgaaggtggagatcaaacgaactgt

SEQ ID NO: 557321 - DNA, 479 bp, Homo sapiens; identical to SEQ ID NO: 554716
  misc_feature: HIJSMM301DPEG8.41.34.D01.1.454.light.4.raw

SEQ ID NO: 557322 - DNA, 491 bp, Homo sapiens
  misc_feature: HIJSMM301CQ7IN.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcgcggagggaccagggtggagatcaaacgaactgtggctgcaccatctgtcttcat

SEQ ID NO: 557323 - DNA, 478 bp, Homo sapiens
  misc_feature: HIJSMM301DF33F.48.5.A05.1.454.light.4.raw
agtatacatacacgaccggtgctcgatttagatagatagacaggggggagtcagacccagtcaggacacagcatggacatgagggtccccgctcagctcctggggctcctgctgctctggctcccaggtgccaaatgtgacatccagatgacccaggctccttccaccctgtctgcatctgtaggagacagagtcaccatcacttgccgggccagtcagagtattgttagctggttggcctggtatcaacagagaccagggaaagcccctaaactcctgatctatacggcatctactttacagagtggggtcccatcaaggttcagcggcagtgcatctgggacagaattcactctcaccatcagcagcctgcagcctgatgattttgcaacttattactgccaacagtattatacttatccatggacgttcggccaagggaccaaggtggaaatcaaacgaactgtggctgcaccat

SEQ ID NO: 557324 - DNA, 506 bp, Homo sapiens
  misc_feature: HIJSMM301BZM9L.19.78.H01.1.454.light.4.raw
tactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaaggcccaaccccactgtca

SEQ ID NO: 557325 - DNA, 484 bp, Homo sapiens
  misc_feature: HIJSMM301CWB0Z.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctgggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaaggtggagatcaacgaa

SEQ ID NO: 557326 - DNA, 495 bp, Homo sapiens; identical to SEQ ID NO: 550605
  misc_feature: HIJSMM301EARXV.41.38.D05.1.454.light.4.raw

SEQ ID NO: 557327 - DNA, 453 bp, Homo sapiens
  misc_feature: HIJSMM301BKAX2.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccgccctcctcccgagagta

SEQ ID NO: 557328 - DNA, 497 bp, Homo sapiens
  misc_feature: HIJSMM301DBIZ5.22.27.C05.1.454.light.4.raw
acatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtcctgaccgattcagtggcagcgggtctgggacagatttcactctcaccatcagcagcctgcaggctgaagatgtggcagtttattactgtcagcaatattatattcctcctcagacgttcggccaagggaccaaggtggaaatcaaacgaactgtggctgcacc

SEQ ID NO: 557329 - DNA, 488 bp, Homo sapiens
  misc_feature: HIJSMM301BOJOC.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcggcggagggaccgaaggtggagagtcaaacgaa

SEQ ID NO: 557330 - DNA, 491 bp, Homo sapiens
  misc_feature: HIJSMM301BAH63.3.78.H01.1.454.light.4.raw
agacgcactccacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtctccatcacttgccgggccagtcagagtattagtcgctggttggcctggtatcagcagaaaccagggaaagcccctaagctcctgatctatcaggcgtctagtttacaaagtggggtcccatcaaggttcagcggcagtggatctgggacagaattcactctcaccatcagcagcctgcagcctgatgattttgcaacttattactgccaacagtataatacttattggacgttcggccaagggaccaaggtggaaatcaaacgaactgtggctgcaccatctgtcttcta

SEQ ID NO: 557331 - DNA, 493 bp, Homo sapiens
  misc_feature: HIJSMM301DXAMW.19.71.G05.1.454.light.4.raw
tactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttatattgtcaacaatattattatacttcgtggacgttcggccaagggaccaaggtggatatcagacgaactgtggctgca

SEQ ID NO: 557332 - DNA, 486 bp, Homo sapiens; identical to SEQ ID NO: 535043
  misc_feature: HIJSMM301AYYWZ.46.35.D02.1.454.light.4.raw

SEQ ID NO: 557333 - DNA, 455 bp, Homo sapiens
  misc_feature: HIJSMM301C0TKZ.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaggtcagcccaaggccaaccccactgtcactctgttcccgccctcctccaccgagagta

SEQ ID NO: 557334 - DNA, 488 bp, Homo sapiens
  misc_feature: HIJSMM301C5QWB.47.46.E02.1.454.light.4.raw
agctcacgtacacgaccggtgctcgatttagactcatctacagggaaaggggaggaactgctcagttaggacccagacggaaccatggaagccccagcgcagcttctcttcctcctgctactctggctcccagagaccactggagaaatagtgatgacgcagtctccagccaccctgtctgtctctccaggggaaagagccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatacaacagcctgcagtctgaagtattttgctagtttattactgtcagcagtatcataactggccgctcaccttcggccaagggacacgactggagaattaaacgaactgtggctgcaccat

SEQ ID NO: 557335 - DNA, 485 bp, Homo sapiens; identical to SEQ ID NO: 535985
  misc_feature: HIJSMM301AFSG2.15.1.A01.1.454.light.4.raw

SEQ ID NO: 557336 - DNA, 507 bp, Homo sapiens; identical to SEQ ID NO: 538702
  misc_feature: HIJSMM301DNTVX.11.57.F02.1.454.light.4.raw

SEQ ID NO: 557337 - DNA, 487 bp, Homo sapiens
  misc_feature: HIJSMM301A3S1S.49.64.F09.1.454.light.4.raw
agtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccggggaaggcccctaagttactgatctatgctgcagccaatttgcaaagtggggtcccatcaaggttcagtggcagtggatctgggacagaattcactctcaccatcagcagtctgcaacctgaagattttggaaagtactattgtcaacagagttacggaaacttgctcattttcggcggagggaccaaggtggagatcaaaagaactgtggctgcaccatctgtcttcta

SEQ ID NO: 557338 - DNA, 516 bp, Homo sapiens; identical to SEQ ID NO: 551269
  misc_feature: HIJSMM301ARUIB.47.53.E09.1.454.light.4.raw

SEQ ID NO: 557339 - DNA, 489 bp, Homo sapiens; identical to SEQ ID NO: 535091
  misc_feature: HIJSMM301BRZ52.47.36.D03.1.454.light.4.raw

SEQ ID NO: 557340 - DNA, 492 bp, Homo sapiens; identical to SEQ ID NO: 540973
  misc_feature: HIJSMM301BPKLQ.43.20.B09.1.454.light.4.raw

SEQ ID NO: 557341 - DNA, 501 bp, Homo sapiens
  misc_feature: HIJSMM301DNXP5.43.77.G11.1.454.light.4.raw
tgtgagtagtcacgaccggtgctcgatttagctagtcactcaagggaaagggggcacaagaggcagcactcaggacagtctccagcatggcctggtcttctctcctcctcactctcctcgctcactgcacagggtcctgggcccagtctgtgctgacgcagccgccctcagtgtctggggccccagggcagagggtcaccatcccctgtactgggagcagtttcaacatcggggcaggtttggatgttaacaggtaccagcaacttccaggatcagcccccaaactcctcatctatggtaccaccaatcggccctcaggagtccctgaccgattctctggctccaagtctggcatctcagccttcctggccatcactggactccaggtcgaggatgaggctgattattactgccaggcctgggacatcagcctgagtggccattatgtcttcggaaccgcgaccaaggtcaccgtcctaggtcagcccaaggcccaacccc

SEQ ID NO: 557342 - DNA, 510 bp, Homo sapiens
  misc_feature: HIJSMM301BG9CR.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgccctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggccgtccgggggccactttcggccctgggaccaaagtaggatatacaaacgaactgtggctgcaccatctgtctt

SEQ ID NO: 557343 - DNA, 447 bp, Homo sapiens; identical to SEQ ID NO: 535201
  misc_feature: HIJSMM301B8IX8.18.9.A09.1.454.light.4.raw

SEQ ID NO: 557344 - DNA, 506 bp, Homo sapiens
  misc_feature: HIJSMM301DJJIW.48.57.F02.1.454.light.4.raw
agtatacatacacgaccggtgctcgatttagctcgatatagttgggtttggggctgtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactgggcccaggtggaggatgaaggtgactacttctgtttctcaacagacaccagtgacaatcatgcgattttcggcggagggaccaagctgaccgtcctgggtcagcccaaggctgccccctcggtcactctcgtt

SEQ ID NO: 557345 - DNA, 510 bp, Homo sapiens
  misc_feature: HIJSMM301BZIZ0.16.85.H08.1.454.light.4.raw
tgtactactccacgaccggtgctcgatttagtatcactcagtcgcggggctgggcctaaggaagcagcactggtggtgcctcagccatggcctggaccgttctcctcctcggcctcatctctcactgcacaggctctgtgacctcctatgtgctgactcagccaccctcggtgtcgttggccccaggacagacggccttaataacctgtgggggaagcaacattggaagcaaaaatgtgcactggtacatgcagaggccaggccaggcccctgttttggtcgtctatgatgataccgagcggccctcagggatccctgagcgattctccggctccaactctggtgacacggccaccctgaccatcaacagggtcgaagtcggggatgaggccgactattactgtcaggtgtgggatggtgttagtgatcgggcacttttcggcggagggacccagctgaccgtcctaggtcagcccaaggctgccccctcggtcactctgttcccaccct

SEQ ID NO: 557346 - DNA, 492 bp, Homo sapiens; identical to SEQ ID NO: 538317
  misc_feature: HIJSMM301CK4NN.10.17.B06.1.454.light.4.raw

SEQ ID NO: 557347 - DNA, 493 bp, Homo sapiens
  misc_feature: HIJSMM301A22CY.49.42.D09.1.454.light.4.raw
agtcgagagacacgaccggtgctcgatttagacacatacgcagggaaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtcgttataactttgtctcctggtaccagcaacacccaggcaaggcccccaaactcttcatttatgatgtcactaatcggccctcaggggtccctgatcgcttctctgcctccaagtctggcaacacggcctccctgaccatctctgggctccaggctgaggatgaggctcattattattgttgctcatatgcaggcaacttcgcttttgtcttcggaactgggaccgaggtcaccgtcctgggtcagcccaagg

SEQ ID NO: 557348 - DNA, 493 bp, Homo sapiens; identical to SEQ ID NO: 535657
  misc_feature: HIJSMM301CMXWJ.27.78.H01.1.454.light.4.raw

SEQ ID NO: 557349 - DNA, 502 bp, Homo sapiens
  misc_feature: HIJSMM301B4H56.15.66.F11.1.454.light.4.raw
tctacgtagccacgaccggtgctcgatttagtcacgcgagaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaagccccaaagtcatcatttatgagctcactaagcggccctcagggtccctgatcgcttctctggctccaagtctggcgactcggcctccctgaccgtctctgggctccagcctgaagatgaggctgattatttctgcggctcatatggagacaattacagctttgtcttcggaagtgggaccaaggtcaccgtcctaagtcagcccaaggccaaccccactgtcactctgttcccgccct

SEQ ID NO: 557350 - DNA, 499 bp, Homo sapiens
  misc_feature: HIJSMM301EUVCD.52.27.C05.1.454.light.4.raw
cgcagtacgacacgaccggtgctcgatttagacgcgatcgaagggtttggggagtctcagtcaggacacagcatggacatgagggtccccgctcagctcctggggctcctgctactctggctccgaggtgccagatgtgacacccagatgacccagtctccatcctccctgtctgcatctgtaggagacagagtcaccatcacgtgccgggcaagtcagagcattggcaggtatttaaattggtatcaacagaaaccagggaaagcccctaggctcctgatctatgctgcatcccgtttgcaaagtggggtcccgtcaaggttcagtggccgtggatctgggacagatttcactctcaccatcagcagtctccaacctgaagattttgcaattttactactgtcaacagagtgacaataaccccctcagactttcggccctcgggaccagagtaggagtatcaaacgaaactagtggctgcaccactctgtcttctatt

SEQ ID NO: 557351 - DNA, 497 bp, Homo sapiens; identical to SEQ ID NO: 538030
  misc_feature: HIJSMM301EQG8V.40.23.C01.1.454.light.4.raw

SEQ ID NO: 557352 - DNA, 514 bp, Homo sapiens; identical to SEQ ID NO: 541418
  misc_feature: HIJSMM301C1J5S.17.33.C11.1.454.light.4.raw

SEQ ID NO: 557353 - DNA, 511 bp, Homo sapiens
  misc_feature: HIJSMM301AODR5.15.34.D01.1.454.light.4.raw
tctacgtagccacgaccggtgctcgatttagatcgtctgtgttgggtttggggggaagcctgagaacacttagccttcatgagtgtccccacccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtggggcgtggcatttgggtgttcggcggagggaccaaactgaccgtcctaggtcagcccaaggctgccccctcggtcact

SEQ ID NO: 557354 - DNA, 506 bp, Homo sapiens
  misc_feature: HIJSMM301BJ8U7.11.57.F02.1.454.light.4.raw
cgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggcaagggaccaaggtggaagtcaagcgaactgtggctgcaccatctgtcttcatcttcccgcc

SEQ ID NO: 557355 - DNA, 504 bp, Homo sapiens
  misc_feature: HIJSMM301CH293.17.34.D01.1.454.light.4.raw
cgtagactagcacgaccggtgctcgatttagatcgtctgtgttgggtttgggtcatcacaatatctgcactggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttcctccgacgttcggtccaacgggaaccgaaggtaggaacgtcaaacgaaacctagtggcgtgcaccaactctgtcttctactctttcccggccccatccttgactagtctacg

SEQ ID NO: 557356 - DNA, 494 bp, Homo sapiens; identical to SEQ ID NO: 535276
  misc_feature: HIJSMM301CKXPM.16.6.A06.1.454.light.4.raw

SEQ ID NO: 557357 - DNA, 454 bp, Homo sapiens; identical to SEQ ID NO: 535005
  misc_feature: HIJSMM301DPNQA.19.86.H09.1.454.light.4.raw

SEQ ID NO: 557358 - DNA, 508 bp, Homo sapiens
  misc_feature: HIJSMM301BU9BJ.40.26.C04.1.454.light.4.raw
tctagcgactcacgaccggtgctcgatttagtctagcgactttgggtttggggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtggggtctgggacagacttcactctcaccgtcagcagactggaccctgaagattttgcagtgtattactgtcaccagcgtagcagctggcctcgaacgttcggccgaaggaccgaggtaggacatcaagcgaactgtggctgcaccatctgtcttcatactccccg

SEQ ID NO: 557359 - DNA, 496 bp, Homo sapiens
  misc_feature: HIJSMM301A4K95.22.5.A05.1.454.light.4.raw
acatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaagagccaccctctcctgcagggccagtcagagtgttaactactacttagcctggtaccaacagaaacctggccaggctcccaggctcctcatctatgatgcatcttacagggccactggcatcccagccaggttcagtggcagtgggtctgggacagacttcactctcaccatcagcagcctagagcctgaagattttgcagtttattactgtcagcagcgtagcaactccctcacgttcggcggagggaccaaggtggagatacaaacgaactgtggctgcaccatctgtcttcatcttcccgcc

SEQ ID NO: 557360 - DNA, 447 bp, Homo sapiens; identical to SEQ ID NO: 535020
  misc_feature: HIJSMM301B2JBW.18.9.A09.1.454.light.4.raw

SEQ ID NO: 557361 - DNA, 492 bp, Homo sapiens
  misc_feature: HIJSMM301CZ65W.13.39.D06.1.454.light.4.raw
tcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggctagtttatactgtcagcaatattatagtactcctccgaggctcactttcggcggagggaccaagggtggagatcaaacgaa

SEQ ID NO: 557362 - DNA, 493 bp, Homo sapiens; identical to SEQ ID NO: 535084
  misc_feature: HIJSMM301CEO84.47.64.F09.1.454.light.4.raw

SEQ ID NO: 557363 - DNA, 445 bp, Homo sapiens
  misc_feature: HIJSMM301BM2GS.9.9.A09.1.454.light.4.raw
tgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaacccctcatctatggtaatagtaatcggccctcaggggtccctgaccgattctctggctccaagtctggcacctcagcctccctggccatcactgggcttcaggctgaggatgaggctgattattactgccactcctatgacagcagcctgagaagtgtggtattcggcggagggaccaagctgaccgtcctaggtcagcccaaggctcgccccctcggtcactctcgttcccgccctcctcgacatatca

SEQ ID NO: 557364 - DNA, 499 bp, Homo sapiens
  misc_feature: HIJSMM301ASK0J.40.57.F02.1.454.light.4.raw
tctagcgactcacgaccggtgctcgatttagctcgatatagttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttatttttgctgctcttatgcaggcagtttcgctctcgaagtgttcggcggagggaccgagctgaccgtcctacgtcagcccaaggctccg

SEQ ID NO: 557365 - DNA, 504 bp, Homo sapiens
  misc_feature: HIJSMM301C8DSA.8.33.C11.1.454.light.4.raw
ctcgcgtgtccacgaccggtgctcgatttagagtgagctcgttgggtttggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactgtggctgcaccatctgtcttcatcttcccgcc

SEQ ID NO: 557366 - DNA, 444 bp, Homo sapiens; identical to SEQ ID NO: 535027
  misc_feature: HIJSMM301D0BXJ.8.73.G07.1.454.light.4.raw

SEQ ID NO: 557367 - DNA, 383 bp, Homo sapiens; identical to SEQ ID NO: 447524
  misc_feature: HIJSMM301DBTOO.41.26.C04.1.454.light.4.raw

SEQ ID NO: 557368 - DNA, 485 bp, Homo sapiens; identical to SEQ ID NO: 536263
  misc_feature: HIJSMM301BC94O.47.78.H01.1.454.light.4.raw

SEQ ID NO: 557369 - DNA, 504 bp, Homo sapiens
  misc_feature: HIJSMM301EA1B4.40.37.D04.1.454.light.4.raw
tctagcgactcacgaccggtgctcgatttagtagcatactgttgggtttgggggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccagggccactggcgtcccggccaggttcagtggcagtgggtctgggacagccttcactctcaccatcagcagcctggagcccgaagattttgcggtttattactgtcagcagcgtgccgactggcccctcacgttcggcggagggaccaaggtggacatcaaacgaactgtggctgcaccatctgtcttcatcttcccgccat

SEQ ID NO: 557370 - DNA, 489 bp, Homo sapiens
  misc_feature: HIJSMM301ASF30.7.85.H08.1.454.light.4.raw
cgtgtctctacacgaccggtgctcgatttagtatcactcagtcgcggggtccaaacagagcttcagcaaacatagtgggaatctgcaccatgccctgggctctgctcctcctgaccctcctcactcactctgcagtgtcagtggtccaggcagggctgactcagccaccctcggtgtccaagggcctgcgacagaccgcaacactcacctgcactgggagcagcaacgatgttggcagggagggagcagcttggctgcagcaacacgagggccaccctcccaaactcctctcctacaggaataacgagcggccctcagggatctcagagagattctctgcatccaggtcaggaaacacagcctccctgaccattactggactccagcctgaggacgaggctgactattactgctcagcatgggacagcggcctcaggacttatgtcttcggaactgggacccacgttaccgtcctacggtcagaccccg

SEQ ID NO: 557371 - DNA, 510 bp, Homo sapiens
  misc_feature: HIJSMM301ELXZ6.21.26.C04.1.454.light.4.raw
tcgtcgctcgcacgaccggtgctcgatttagtctagcgactttgggtttggggagagaagagctgctcagttaggacccagagggaaccatggaaaccccagcgcagcttctcttcctcctgctactctggctcccagataccaccggagaaattgtgttgacgcagtctccggacaccctgtctttgtctccaggggaaagagccaccctctcctgcagggccagtcagattgttggcaacaactacttagcctggtaccagcagaaacctggccaggctcccaggctcctcatccatactgcctccaagagggccactggcatccctgacaggttcagtggcagtgggtctgggacagacttcactctcaccatcaccagactggagccggatgattttgcagtttattactgccaccaacatgctttcgcaccgctcacgttcggcggagggaccagggtggagatcaaacgaactgtggctgcaccatctgtcttcatcttccccg

SEQ ID NO: 557372 - DNA, 515 bp, Homo sapiens; identical to SEQ ID NO: 541898
  misc_feature: HIJSMM301C9J07.16.66.F11.1.454.light.4.raw

SEQ ID NO: 557373 - DNA, 504 bp, Homo sapiens
  misc_feature: HIJSMM301AOBBG.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagaattaaacg

SEQ ID NO: 557374 - DNA, 505 bp, Homo sapiens
  misc_feature: HIJSMM301BA99Y.8.33.C11.1.454.light.4.raw
ctcgcgtgtccacgaccggtgctcgatttagagtgagctcgttgggtttggggggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccacttcggccctgggaccaggtggagatcaaacgaactgtggctgcaccatctgtcttcatt

SEQ ID NO: 557375 - DNA, 460 bp, Homo sapiens; identical to SEQ ID NO: 536053
  misc_feature: HIJSMM301A69ZA.22.28.C06.1.454.light.4.raw

SEQ ID NO: 557376 - DNA, 512 bp, Homo sapiens; identical to SEQ ID NO: 542831
  misc_feature: HIJSMM301A2J1Z.43.19.B08.1.454.light.4.raw

SEQ ID NO: 557377 - DNA, 495 bp, Homo sapiens
  misc_feature: HIJSMM301BDNQC.41.53.E09.1.454.light.4.raw
tctatactatcacgaccggtgctcgatttagagagagtgtgttgggtttggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggagggaccaagctgaccgtcctaggtcagcccaagg

SEQ ID NO: 557378 - DNA, 489 bp, Homo sapiens; identical to SEQ ID NO: 554439
  misc_feature: HIJSMM301BNDNX.14.55.E11.1.454.light.4.raw
  modified_base (427)..(427): a, c, t, g, unknown or other

SEQ ID NO: 557379 - DNA, 494 bp, Homo sapiens; identical to SEQ ID NO: 534994
  misc_feature: HIJSMM301ESPH8.27.78.H01.1.454.light.4.raw

SEQ ID NO: 557380 - DNA, 494 bp, Homo sapiens; identical to SEQ ID NO: 535629
  misc_feature: HIJSMM301BMTRE.4.27.C05.1.454.light.4.raw

SEQ ID NO: 557381 - DNA, 493 bp, Homo sapiens; identical to SEQ ID NO: 535084
  misc_feature: HIJSMM301AUT4A.47.64.F09.1.454.light.4.raw

SEQ ID NO: 557382 - DNA, 447 bp, Homo sapiens; identical to SEQ ID NO: 535020
  misc_feature: HIJSMM301BFE2I.18.9.A09.1.454.light.4.raw

SEQ ID NO: 557383 - DNA, 517 bp, Homo sapiens; identical to SEQ ID NO: 541775
  misc_feature: HIJSMM301BQ0QM.5.27.C05.1.454.light.4.raw

SEQ ID NO: 557384 - DNA, 474 bp, Homo sapiens; identical to SEQ ID NO: 538184
  misc_feature: HIJSMM301DWT49.13.76.G10.1.454.light.4.raw

SEQ ID NO: 557385 - DNA, 502 bp, Homo sapiens
  misc_feature: HIJSMM301DI5E5.40.23.C01.1.454.light.4.raw
tctagcgactcacgaccggtgctcgatttagtacacgtgattagggattggggggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtcttagcaactacttagtctggtaccaacagaaacctggccaggctcccaggctcctcatctatgatgcatccagcagggccactggcatcccagccaggttcagtggcagtgggtctgggacagacttcactctcaccatcagcggcctagagcctgaagactttgcagtttattactgtcagcagcgtaccaactggccgctcactttcggcggagggaccaaggtggagatcaaacgaactgtggctgcaccatctgtcttcatcttccccg

SEQ ID NO: 557386 - DNA, 495 bp, Homo sapiens
  misc_feature: HIJSMM301A8OLU.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaactagtggctgcaccatctgtctt

SEQ ID NO: 557387 - DNA, 510 bp, Homo sapiens
  misc_feature: HIJSMM301BODY1.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccgggggccactttcggccctcgggaccaaagtaggatatcaaacgaactgtggctgcaccatctgtcttcta

SEQ ID NO: 557388 - DNA, 446 bp, Homo sapiens
  misc_feature: HIJSMM301D610A.48.86.H09.1.454.light.4.raw
agtatacatacacgaccggtgctcgatttagtgctatagacttgggtttgggggacgtcgtgatgacccagtctccagactccctggcagtgtctctgggcgggagggccaccatcaactgcaagtccagccagagtattttatacagctcctacaataagagcgacttagcttggtaccagcagaaaccaggacagcctcctaagttgctcatttactgggcatctaaccggcaatccggggtccctgaccgattcagtggcagcgggtctgggacacatttcgctttcaccatcagcagcctgcaggctgaggatgtggcagtttattactgtcagcaatattatactactccgtggactttcggccaagggaccaaggtggaaatcagacgaactgtggctgcaccatctgtcttcatcttcccgccatctgatatgtatact

SEQ ID NO: 557389 - DNA, 494 bp, Homo sapiens; identical to SEQ ID NO: 534992
  misc_feature: HIJSMM301AQ6O0.9.1.A01.1.454.light.4.raw

SEQ ID NO: 557390 - DNA, 491 bp, Homo sapiens
  misc_feature: HIJSMM301AV3O6.49.30.C08.1.454.light.4.raw
agtcgagagacacgaccggtgctcgatttagtctgacgtcaaagggaaagggggcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactggaagcagctccaacatcggggcaggctttgatgtccactggtaccagcagcttccaggaacagcccccaaactcctcatctatggtaacaacaatcggccctcaggggtccctgaccgattctctgcctccaagtctgccacctcggcctccctggccatcactgggctccaggctgaagatgaggctgattattactgccagtcctatgacagcaccatgagtcgttccgtggtcttcggcggagggacccagctgaccgtccg

SEQ ID NO: 557391 - DNA, 494 bp, Homo sapiens; identical to SEQ ID NO: 535828
  misc_feature: HIJSMM301EJPLX.3.36.D03.1.454.light.4.raw

SEQ ID NO: 557392 - DNA, 509 bp, Homo sapiens
  misc_feature: HIJSMM301CJBIJ.15.3.A03.1.454.light.4.raw
  modified_base (475)..(475): a, c, t, g, unknown or other
tctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtatcagaaaaaccaggacagcctcctaagctgctcatttactgggcatctacccgggaatccggggtccctgaccgattcagtggcagcgggtctggcacagatttcactctcaccatcagcagcctgcaggctgaagatgtggcagtttattactgtcagcaatatgaaaagtactttccttttactttcgtccgtcggtcgaacgtaagagtatanaacaaacgtaactggtagtcgtgaccactacttc

SEQ ID NO: 557393 - DNA, 418 bp, Homo sapiens
  misc_feature: HIJSMM301CHBON.41.53.E09.1.454.light.4.raw
tctatactatcacgaccggtgctcgatttagagagagtgtgttgggtttgggggctttgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctgacaacacggcctccctgaccatctctgggctccaggctgaggacgaggctgattattactgcagctcatatacaagcagcagcactctcgtggtattcggcggagggaccaagctgaccgtcctaggtcagcccaaggctgcccctcggtcactctgttcccaccctcctcatagtataga

SEQ ID NO: 557394 - DNA, 489 bp, Homo sapiens
  misc_feature: HIJSMM301BJRSC.52.53.E09.1.454.light.4.raw
  modified_base (436)..(436): a, c, t, g, unknown or other
cgcagtacgacacgaccggtgctcgatttagagagagtgtgttgggtttgggggagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacggtatccctgatcgcttctcaggctccggctctgggactgagcgctacctcaccatctccagcctccagtctgaggacgagggtgactattactgtcagacgtgggacactggcatttgggngttcggcggagggaccaagttgaccgtcctaggtcagcccaaggctgcccccc

SEQ ID NO: 557395 - DNA, 504 bp, Homo sapiens; identical to SEQ ID NO: 542968
  misc_feature: HIJSMM301DJN4I.11.57.F02.1.454.light.4.raw

SEQ ID NO: 557396 - DNA, 447 bp, Homo sapiens; identical to SEQ ID NO: 535201
  misc_feature: HIJSMM301CDPDK.18.9.A09.1.454.light.4.raw

SEQ ID NO: 557397 - DNA, 505 bp, Homo sapiens
  misc_feature: HIJSMM301BBYCL.3.79.H02.1.454.light.4.raw
agacgcactccacgaccggtgctcgatttagtgtcacacgaagggaaaggggggtcgtcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttatatctctgtctcctggtaccaacaacacccaggcaaagcccccaaactcatcatttatgatgtcactgctcggccctcaggggtttctcatcgcttttctggctccaagtctggcaccacggcctccctgaccatctcggggctccaggctgaggacgaggctgcttattactgcagctcatatacaaggagcaccactctcgtggtatttggtggagggaccaagctgaccgtcctaggtcagcccaaggctgccccctcggt

SEQ ID NO: 557398 - DNA, 494 bp, Homo sapiens; identical to SEQ ID NO: 539894
  misc_feature: HIJSMM301CDJ3O.16.53.E09.1.454.light.4.raw

SEQ ID NO: 557399 - DNA, 491 bp, Homo sapiens; identical to SEQ ID NO: 538021
  misc_feature: HIJSMM301D2YH5.3.72.G06.1.454.light.4.raw

SEQ ID NO: 557400 - DNA, 479 bp, Homo sapiens
  misc_feature: HIJSMM301CQK8I.52.1.A01.1.454.light.4.raw
cgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtggggtcccatcaaggttcagtggcagtggatctgggacagaattcactctcaccatcaccagtctgcaggctgaggattttgcaacttacttctgtcaacagagttacagttccctcacttttcggccctgggaccatagtggatatcaaacgaactgtggctgcaccatctgt

SEQ ID NO: 557401 - DNA, 500 bp, Homo sapiens; identical to SEQ ID NO: 546095
  misc_feature: HIJSMM301CUDFL.52.78.H01.1.454.light.4.raw

SEQ ID NO: 557402 - DNA, 444 bp, Homo sapiens; identical to SEQ ID NO: 538511
  misc_feature: HIJSMM301D7ND4.5.9.A09.1.454.light.4.raw
  modified_base (426)..(426): a, c, t, g, unknown or other

SEQ ID NO: 557403 - DNA, 486 bp, Homo sapiens; identical to SEQ ID NO: 535385
  misc_feature: HIJSMM301EC7W3.19.71.G05.1.454.light.4.raw

SEQ ID NO: 557404 - DNA, 484 bp, Homo sapiens
  misc_feature: HIJSMM301AQ5H8.3.88.H11.1.454.light.4.raw
agacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggtgagtcagggtattagcagctggttagcctggtatcagcagaaaccagggaaagcccctaagctcctgatctatgctgcatccactttgcaaactggggtcccatccaggttcagcggcaggggatctgggacagatttcactctcaccatcagcagcctgcagcctgaagattttgcaacttactattgtcaacaggctaacagtttccctttaatcttcggccaagggacacgactggagattaaacgaactgtggctgcacc

SEQ ID NO: 557405 - DNA, 508 bp, Homo sapiens
  misc_feature: HIJSMM301A2UM5.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccggggccactttcggccctgggaccgaaggtggagatcaaacgaactgtggctgcaccatctgtcttcta

SEQ ID NO: 557406 - DNA, 505 bp, Homo sapiens
  misc_feature: HIJSMM301DVNJI.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccgggatgagccgactattactgtcaggtgtgggatagtagtggtgatcatccatacgtcttcggaactgggaccaaggtctccgtcctacgtcagcccaaggccaacccactgtcactctgttccc

SEQ ID NO: 557407 - DNA, 500 bp, Homo sapiens; identical to SEQ ID NO: 544063
  misc_feature: HIJSMM301A91IC.12.18.B07.1.454.light.4.raw

SEQ ID NO: 557408 - DNA, 514 bp, Homo sapiens
  misc_feature: HIJSMM301C3SRR.8.43.D10.1.454.light.4.raw
ctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttatagtacaaacaacagacactcctggacccctgcccggttctcaggctccctccttggggccaaagctgccctgacactgtcaggtgtgcagcctgaggacgaggctgagtattactgcctgctctattatggtgggccttgggtgttcggcggagggaccaagctgaccgtcctaggtcagcccaaggctgccccctcggtcactctgttcccacctcctcgacacgcg

SEQ ID NO: 557409 - DNA, 521 bp, Homo sapiens
  misc_feature: HIJSMM301EOTCM.27.23.C01.1.454.light.4.raw
  modified_base (518)..(518): a, c, t, g, unknown or other
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgtttcggcggagggaccaggctgaccgtcctaggtcagcccaaggctgccccctcggtcactctgttcccncct

SEQ ID NO: 557410 - DNA, 505 bp, Homo sapiens; identical to SEQ ID NO: 535987
  misc_feature: HIJSMM301CIJOM.18.37.D04.1.454.light.4.raw

SEQ ID NO: 557411 - DNA, 523 bp, Homo sapiens
  misc_feature: HIJSMM301DE5A9.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagccgtgtggggcagggtcaggcccaaggccaacccccactgtcactctccg

SEQ ID NO: 557412 - DNA, 493 bp, Homo sapiens
  misc_feature: HIJSMM301ENDN5.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagcccccaagtcgttctctatgatgtcactaagcggccctcaggagtccctgatcgattctctggctccaagtctggcaacacggcctcctgaacatctctgggctccaggctgaggatgaggctgattattattgctgctcatatggaagtacctactcttttctcttcggaactgggaccacggtcaccgtcctaggtcagcccaaggccaaccca

SEQ ID NO: 557413 - DNA, 487 bp, Homo sapiens; identical to SEQ ID NO: 536536
  misc_feature: HIJSMM301AYVVZ.26.45.E01.1.454.light.4.raw

SEQ ID NO: 557414 - DNA, 498 bp, Homo sapiens
  misc_feature: HIJSMM301DYQ8H.12.87.H10.1.454.light.4.raw
atacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcattgggggaaaagtttgctttctggtatcagcagaagccaggccagtcccctgtcttggtcatctataaggatagcaggcggccctcagggattcctgagcgattctccggctccaactccggcaacacagccactctgacccatcagcgggacccaggctctcgatgaggctgactattactgccaggcgtgggacagctccacttcccgttatgtcttcggaggtgggaccatggtcaccgtcctaggtcagcccaagaccaaccccactgt

SEQ ID NO: 557415 - DNA, 454 bp, Homo sapiens; identical to SEQ ID NO: 536347
  misc_feature: HIJSMM301AFIWK.19.86.H09.1.454.light.4.raw

SEQ ID NO: 557416 - DNA, 499 bp, Homo sapiens; identical to SEQ ID NO: 537800
  misc_feature: HIJSMM301D0J4H.22.38.D05.1.454.light.4.raw

SEQ ID NO: 557417 - DNA, 499 bp, Homo sapiens
  misc_feature: HIJSMM301EN7EB.12.26.C04.1.454.light.4.raw
atacgacgtacacgaccggtgctcgatttagtctagcgactttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttattcaactccaacaatgagaactacttagcttggtaccagcagaaaccaggacagccgcccaagttgctcatttactgggcatctacccgggaatccggggtccctgaccgattcagtggcagcgggtctgagacagatttcactctcaccatcagcagcctgcaggccgaagatgtggcagtttatttttgtcagcaatattatcatactccgctcactttcggcggagggaccaaggtggagatcaaacgaactgtggctgcacc

SEQ ID NO: 557418 - DNA, 523 bp, Homo sapiens
  misc_feature: HIJSMM301A2X5M.15.34.D01.1.454.light.4.raw
tctacgtagccacgaccggtgctcgatttagatcgtctgtgttgggtttgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtggggcgtggcatttgggtgttcggcggagggaccaaactgaccgtcctaggtcagccccg

SEQ ID NO: 557419 - DNA, 488 bp, Homo sapiens
  misc_feature: HIJSMM301ERSA2.41.72.G06.1.454.light.4.raw
tctatactatcacgaccggtgctcgatttagctacgactgcaagggaaaggggctccaaacagagcttcagcaagcatagtgggaatctgcaccatgccctgggctctgctcctcctgaccctcctcactcactctgcagtgtcagtggtccaggcagggctgactcagccaacctcggtgtccgaggggttgggacagaccgccacactcacctgcactgggaacaacaacaatgttggcgaccaaggagcaacttggctgcagcagcaccagggccaccctcccaaactcctatcctacaggaataacaaccggccctcagggatctcagagagattctctgcatccaggtcaggaaacacagcctccctgaccattactggactccagcctgaggacgaggctgactattactgctcagcatgggacagcagcctcacaaattggatgttcggcggagggaccaaagctgaccgtcctaggtcag

SEQ ID NO: 557420 - DNA, 486 bp, Homo sapiens
  misc_feature: HIJSMM301ENAX2.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttatctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaa

SEQ ID NO: 557421 - DNA, 485 bp, Homo sapiens; identical to SEQ ID NO: 535985
  misc_feature: HIJSMM301B8KDO.15.1.A01.1.454.light.4.raw

SEQ ID NO: 557422 - DNA, 502 bp, Homo sapiens; identical to SEQ ID NO: 549179
  misc_feature: HIJSMM301CQNQL.14.57.F02.1.454.light.4.raw

SEQ ID NO: 557423 - DNA, 501 bp, Homo sapiens; identical to SEQ ID NO: 550407
  misc_feature: HIJSMM301DFTSP.4.39.D06.1.454.light.4.raw

SEQ ID NO: 557424 - DNA, 512 bp, Homo sapiens
  misc_feature: HIJSMM301CYFCL.16.46.E02.1.454.light.4.raw
tgtactactccacgaccggtgctcgatttagactcatctacagggaaagggggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaaccccactcgtcactctcg

SEQ ID NO: 557425 - DNA, 484 bp, Homo sapiens; identical to SEQ ID NO: 535400
  misc_feature: HIJSMM301DQ471.46.26.C04.1.454.light.4.raw

SEQ ID NO: 557426 - DNA, 493 bp, Homo sapiens
  misc_feature: HIJSMM301DEE6N.41.54.E10.1.454.light.4.raw
tctatactatcacgaccggtgctcgatttagatcgtagcagaacacacaaaggggactgatcaggactcctcagttcaccttctcacaatgaggctccctgctcagctcctggggctgctaatgctctgggtcccaggatgcagtggggatgctattctgactcagtcgccgctctccctgcccgtctcccttggacagccggcctccatttcctgcacgtctagtcaaagtctcctacatgatgatggaaacacctacctgacttggtttcaccacaggccaggccaatctccaaggcgcctaatttatcaggtttcgaagcgggactctggggtcccaggcagattcagcggcagtgggtcaggctctgctttcacgctgagaatcaacagggtggaggctgaggatgttggtgtttattactgcatgcaaggttcatattggccgtgcagttttggccaggggaccaaggttggagatcaaacgaactgt

SEQ ID NO: 557427 - DNA, 501 bp, Homo sapiens
  misc_feature: HIJSMM301BQ8C3.17.27.C05.1.454.light.4.raw
cgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtcatttatggtaagaataaccggccctcagggatcccagaccgattctctggctccgactcaggaaagacagcttccctgaccatcactgggctcaggcggaagatgaggctgactattactgtaactcccgggacagcagtgctgaccaggtggtattcggcggagggacccacctgaccgtcttaggtcagcccaaggctgccccctcggtcta

SEQ ID NO: 557428 - DNA, 485 bp, Homo sapiens; identical to SEQ ID NO: 535606
  misc_feature: HIJSMM301CEROY.47.46.E02.1.454.light.4.raw

SEQ ID NO: 557429 - DNA, 507 bp, Homo sapiens
  misc_feature: HIJSMM301CJ9W0.15.59.F04.1.454.light.4.raw
tctacgtagccacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaaagctgccctcaccatcacgggggcccaggcagatgatgaatctgtttattattgtgtcctatatatgggtgctggcatttcggtcttcggcggagggaccaagctgaccgtcctaggtcagcccaaggctgccccctcggt

SEQ ID NO: 557430 - DNA, 493 bp, Homo sapiens; identical to SEQ ID NO: 535047
  misc_feature: HIJSMM301C6CJN.16.53.E09.1.454.light.4.raw

SEQ ID NO: 557431 - DNA, 492 bp, Homo sapiens
  misc_feature: HIJSMM301AECPQ.49.81.H04.1.454.light.4.raw
agtcgagagacacgaccggtgctcgatttagtagtgtagattcgcgggggcaggagtcagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatctaccactcactttcggcggagggaccgacggtggagagtacaaacgaaactgtaggcgtgcaccactt

SEQ ID NO: 557432 - DNA, 492 bp, Homo sapiens; identical to SEQ ID NO: 537666
  misc_feature: HIJSMM301BXSKY.43.33.C11.1.454.light.4.raw

SEQ ID NO: 557433 - DNA, 486 bp, Homo sapiens; identical to SEQ ID NO: 535043
  misc_feature: HIJSMM301ADO89.46.35.D02.1.454.light.4.raw

SEQ ID NO: 557434 - DNA, 506 bp, Homo sapiens; identical to SEQ ID NO: 534969
  misc_feature: HIJSMM301DE13B.18.37.D04.1.454.light.4.raw

SEQ ID NO: 557435 - DNA, 511 bp, Homo sapiens; identical to SEQ ID NO: 545382
  misc_feature: HIJSMM301A4CAK.15.34.D01.1.454.light.4.raw

SEQ ID NO: 557436 - DNA, 502 bp, Homo sapiens
  misc_feature: HIJSMM301A9Q8T.10.9.A09.1.454.light.4.raw
catagtagtgcacgaccggtgctcgatttagcgagacgcgcaggggcagagccctggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccacttcggccctgggaccaaagtggagatcaaacgaactagtggctgcacca

SEQ ID NO: 557437 - DNA, 446 bp, Homo sapiens
  misc_feature: HIJSMM301D7VCK.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctcgccccctcggtcactctcgttcccaccctcctccgtgtctgat

SEQ ID NO: 557438 - DNA, 487 bp, Homo sapiens
  misc_feature: HIJSMM301BIK1U.40.37.D04.1.454.light.4.raw
tctagcgactcacgaccggtgctcgatttagtagcatactgttggggtttgggggatcaggacttctcagttcatcttctcaccatgaggcctccctgctcagctcctggggctgctaatgctctggatccctggttccagtgcgagggttgtgatgactcagactccactctctctgtccgtcacccctggacagccggcctccatctcctgcaagtctgctcagagcctcctgcatggtgatggaatcacctatttatattggtacctgcagaagccaggccagtctccacagctcctaatctatgaggtttccagccggttctctggagtgccagataggttcagtggcagcgggtcagtgacagatttcacactgaaaatcagccgggtggaggctgaggatgttggggtttattactgcatgcaaggtttataccttcctcggacttcggtccctgggaccgagagtggatgtcaacgaact

SEQ ID NO: 557439 - DNA, 501 bp, Homo sapiens; identical to SEQ ID NO: 535873
  misc_feature: HIJSMM301CZYEB.17.27.C05.1.454.light.4.raw

SEQ ID NO: 557440 - DNA, 448 bp, Homo sapiens
  misc_feature: HIJSMM301AZYFN.11.86.H09.1.454.light.4.raw
cgagagataccacgaccggtgctcgatttagtgctatagacttgggtcctgggcccagtctgtgctgactcagccaccctcagcgtctgggacccccgggcagagggtcatcatctcttgttctggaagcagctctaatatcggaagtaatactgtaaattggtatcaacaactcccaggaacggcccccaaactcctcatctatagtaataatcagcggccctcaggggtccctgaccgattctctggctccaagtctggcacctcagcctccctggccatcagtgggctccagtctgatgatgaggctgattattactgtgcagcatgggatgacaccctgaatggtccttgtgtggttttcggcggagggaccaagctgaccgtcctaggtcagcccaaggctgccccctcggtcactctgttcccaccctcctcgtatctctcg

SEQ ID NO: 557441 - DNA, 473 bp, Homo sapiens; identical to SEQ ID NO: 535262
  misc_feature: HIJSMM301A4J5Z.8.67.G01.1.454.light.4.raw

SEQ ID NO: 557442 - DNA, 480 bp, Homo sapiens
  misc_feature: HIJSMM301BJKIZ.8.53.E09.1.454.light.4.raw
ctcgcgtgtccacgaccggtgctcgatttagagagagtgtgttgggtttggggggctctgcttcagctgtgggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggacc

SEQ ID NO: 557443 - DNA, 454 bp, Homo sapiens; identical to SEQ ID NO: 536347
  misc_feature: HIJSMM301D4AOZ.19.86.H09.1.454.light.4.raw

SEQ ID NO: 557444 - DNA, 494 bp, Homo sapiens; identical to SEQ ID NO: 534994
  misc_feature: HIJSMM301BB95R.27.78.H01.1.454.light.4.raw

SEQ ID NO: 557445 - DNA, 513 bp, Homo sapiens
  misc_feature: HIJSMM301EH1GZ.48.72.G06.1.454.light.4.raw
agtatacatacacgaccggtgctcgatttagctacgactgcaagggaaaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatccggtcttcggcggagggaccaagttgaccgtcctaagtcagcccaaggctgccccctcggtcactctgttcccgcct

SEQ ID NO: 557446 - DNA, 501 bp, Homo sapiens; identical to SEQ ID NO: 555551
  misc_feature: HIJSMM301A7KBU.21.81.H04.1.454.light.4.raw

SEQ ID NO: 557447 - DNA, 507 bp, Homo sapiens; identical to SEQ ID NO: 554434
  misc_feature: HIJSMM301A7T27.8.28.C06.1.454.light.4.raw

SEQ ID NO: 557448 - DNA, 510 bp, Homo sapiens
  misc_feature: HIJSMM301E3YBY.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaacgggaccgaaggtaggaaagtacaaacgaaactagtggctgcaccatctgtcttctatcttccccg

SEQ ID NO: 557449 - DNA, 517 bp, Homo sapiens
  misc_feature: HIJSMM301DLO2Y.9.2.A02.1.454.light.4.raw
tgatacgtctcacgaccggtgctcgatttagactcatctacaggggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacgaatagcgacattggtggctctaatcatgtctcctggtactataacagtccaggcaaagcccccaaactcataatttatgatgtctttagacggccctcagggatttcttctcggttgtctggctccaagtctgggaacacggcctccctgaccatctctggacttcagcctgaggacgagggtgattacttctgcagttcagattcagaaacttcccctcgttgggtgttcggcggagggaccatgctgaccgtcctgagtcagcccaaggctgccccctcggtcactctgttcccgccct

SEQ ID NO: 557450 - DNA, 492 bp, Homo sapiens; identical to SEQ ID NO: 537395
  misc_feature: HIJSMM301ETF2K.16.73.G07.1.454.light.4.raw

SEQ ID NO: 557451 - DNA, 483 bp, Homo sapiens; identical to SEQ ID NO: 545413
  misc_feature: HIJSMM301BED9W.16.81.H04.1.454.light.4.raw

SEQ ID NO: 557452 - DNA, 514 bp, Homo sapiens; identical to SEQ ID NO: 547648
  misc_feature: HIJSMM301BFWP3.16.1.A01.1.454.light.4.raw

SEQ ID NO: 557453 - DNA, 493 bp, Homo sapiens; identical to SEQ ID NO: 536769
  misc_feature: HIJSMM301A8T2E.19.83.H06.1.454.light.4.raw

SEQ ID NO: 557454 - DNA, 488 bp, Homo sapiens; identical to SEQ ID NO: 536861
  misc_feature: HIJSMM301AMJT9.12.88.H11.1.454.light.4.raw

SEQ ID NO: 557455 - DNA, 498 bp, Homo sapiens
  misc_feature: HIJSMM301EX4GP.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggccaagggaccagggtggaaagtacaaacgaaactagtggctgcaccatctgtcttcat

SEQ ID NO: 557456 - DNA, 492 bp, Homo sapiens
  misc_feature: HIJSMM301BAHBY.48.65.F10.1.454.light.4.raw
agtatacatacacgaccggtgctcgatttagctacgctctaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgaggacagtaagcggccctcaggggtttctaatcgcttctctggctccaagtctggcaacacggcctccctgacaatctctgggctccaggctgaggacgaggctgattattactgctgctcatatgcagatagtagcactcatggtggtattcggcggagggaccaagctgaccgtcctaggtcagcccaaggctcg

SEQ ID NO: 557457 - DNA, 489 bp, Homo sapiens; identical to SEQ ID NO: 536013
  misc_feature: HIJSMM301AI4BB.26.23.C01.1.454.light.4.raw

SEQ ID NO: 557458 - DNA, 484 bp, Homo sapiens; identical to SEQ ID NO: 535240
  misc_feature: HIJSMM301AFKQT.47.60.F05.1.454.light.4.raw

SEQ ID NO: 557459 - DNA, 519 bp, Homo sapiens
  misc_feature: HIJSMM301EGXWW.52.57.F02.1.454.light.4.raw
cgcagtacgacacgaccggtgctcgatttagctcgatatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtgcttatgactttgtctcctggtaccaacaccaccctggcaaagcccccaaactcatcatttttgaggtcactaagcggccctcaggggtccctgatcgcttctctggctcgaagtctggcaacacggcctccctgaccgtctctgggctccaggctgaggatgaggctgattactactgcacctcatatgcaggcgacaacaatttgggggttttcgcggagggaccaaggtgaccgtcctacgtcagcccaaggctgccccctcggtcactctgttccccg

SEQ ID NO: 557460 - DNA, 481 bp, Homo sapiens
  misc_feature: HIJSMM301AED31.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggacttcgtccgacggacgaacggtaggaagtacaacgaactagtggcgtg

SEQ ID NO: 557461 - DNA, 493 bp, Homo sapiens
  misc_feature: HIJSMM301D729G.11.81.H04.1.454.light.4.raw
cgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttttactgtcagcagtatagtaactggcctccgtacacttttggccaggggaccaagctagaaatcaaacgaactgtggctgcaccatctgtcttca

SEQ ID NO: 557462 - DNA, 508 bp, Homo sapiens; identical to SEQ ID NO: 537871
  misc_feature: HIJSMM301AV66M.8.33.C11.1.454.light.4.raw

SEQ ID NO: 557463 - DNA, 484 bp, Homo sapiens; identical to SEQ ID NO: 535400
  misc_feature: HIJSMM301A5VGP.46.26.C04.1.454.light.4.raw

SEQ ID NO: 557464 - DNA, 464 bp, Homo sapiens; identical to SEQ ID NO: 538763
  misc_feature: HIJSMM301DQKRI.49.4.A04.1.454.light.4.raw

SEQ ID NO: 557465 - DNA, 490 bp, Homo sapiens
  misc_feature: HIJSMM301DWQK0.21.55.E11.1.454.light.4.raw
tcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattatttgccggacaagtcacgacataaacacctttttaaattggtatcagcacaaaccagggaaggccccaaagctcctgatcgatgctgcatccaatttagagagtggggtcccatccaggttcagtggcgatggatctgggacaaatttcactctcaccatcagcagtctgcaacctgaagattttgcaacttactattgtcaacagagttacagtattccttttcacttttcggccctgggaccgaagtcgatatcaaacgaactgtggctgcaccatctgt

SEQ ID NO: 557466 - DNA, 454 bp, Homo sapiens; identical to SEQ ID NO: 536449
  misc_feature: HIJSMM301A4716.18.78.H01.1.454.light.4.raw

SEQ ID NO: 557467 - DNA, 479 bp, Homo sapiens; identical to SEQ ID NO: 535188
  misc_feature: HIJSMM301CA4UH.10.74.G08.1.454.light.4.raw

SEQ ID NO: 557468 - DNA, 410 bp, Homo sapiens
  misc_feature: HIJSMM301BVZWC.10.86.H09.1.454.light.4.raw
catagtagtgcacgaccggtgctcgatttagtgctatagacttgggtttgggaacctatgaacattctgtaggggtcaccgtctcctgctctggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccagaccggggacgaggccgattattacctgcgcaacttgggactccaacctgactgttggggctttcggcggagggactaagttgaccgtcctacgtcagcccaaggctgcccctcggtcactctgttcccgccctcctccactactatg

SEQ ID NO: 557469 - DNA, 478 bp, Homo sapiens; identical to SEQ ID NO: 545407
  misc_feature: HIJSMM301DVCO7.5.70.G04.1.454.light.4.raw

SEQ ID NO: 557470 - DNA, 488 bp, Homo sapiens; identical to SEQ ID NO: 535990
  misc_feature: HIJSMM301EW778.11.28.C06.1.454.light.4.raw

SEQ ID NO: 557471 - DNA, 490 bp, Homo sapiens; identical to SEQ ID NO: 541244
  misc_feature: HIJSMM301D5TYF.41.44.D11.1.454.light.4.raw

SEQ ID NO: 557472 - DNA, 467 bp, Homo sapiens
  misc_feature: HIJSMM301CD7F2.49.27.C05.1.454.light.4.raw
agtcgagagacacgaccggtgctcgatttagacgcgatcgaagggtttgggggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctcccgctcactttcgcgggggaccgaaggtggagatccagcgaa

SEQ ID NO: 557473 - DNA, 505 bp, Homo sapiens
  misc_feature: HIJSMM301CGG8O.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaaattgagatcaaacgaaactgtggctgcaccatctgtcttcatcttcccgcc

SEQ ID NO: 557474 - DNA, 496 bp, Homo sapiens; identical to SEQ ID NO: 536802
  misc_feature: HIJSMM301ETRE3.5.24.C02.1.454.light.4.raw

SEQ ID NO: 557475 - DNA, 514 bp, Homo sapiens
  misc_feature: HIJSMM301DHM72.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctggggacacattttcaccctcaccatcaatagcctggaagctgaagatgctgcaacttattactgtcatcagagtactactttactcaagtgatcacccttcggtccgaacgggaacgaacgactcggagaattaaaacg

SEQ ID NO: 557476 - DNA, 485 bp, Homo sapiens; identical to SEQ ID NO: 536799
  misc_feature: HIJSMM301DSER8.19.71.G05.1.454.light.4.raw

SEQ ID NO: 557477 - DNA, 493 bp, Homo sapiens; identical to SEQ ID NO: 535084
  misc_feature: HIJSMM301ARERI.47.64.F09.1.454.light.4.raw

SEQ ID NO: 557478 - DNA, 493 bp, Homo sapiens
  misc_feature: HIJSMM301DZG0C.53.31.C09.1.454.light.4.raw
cgcgtatacacacgaccggtgctcgatttagacgtctcatcaaggaaggaaggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaacaatatgcttactggtaccagcagaggccaggccaggcccctgtcttggtgatttataaagactttgagaggccctcagggacccctgagcgattctctggctccagctcagggacaacagtcaccttgaccatcagtggagtccggccagaggacgaggctgactattactgtcagtccgcagacagcagtggcagttatgtcgtattcggcggagggactacgctgaccgtcctaggtcagcccaaggctgccccctc

SEQ ID NO: 557479 - DNA, 488 bp, Homo sapiens
  misc_feature: HIJSMM301AR3WO.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattctccagcgttcggccagggaccgaaggtggaagtcaagcgaactgtggctgcaccatctgt

SEQ ID NO: 557480 - DNA, 473 bp, Homo sapiens
  misc_feature: HIJSMM301DL9KG.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctcctccgagtgccacgttttggcggggggaccaaggtggacatcaaacgaa

SEQ ID NO: 557481 - DNA, 496 bp, Homo sapiens; identical to SEQ ID NO: 535109
  misc_feature: HIJSMM301CMYCK.16.78.H01.1.454.light.4.raw

SEQ ID NO: 557482 - DNA, 494 bp, Homo sapiens; identical to SEQ ID NO: 534994
  misc_feature: HIJSMM301AVQW3.27.78.H01.1.454.light.4.raw

SEQ ID NO: 557483 - DNA, 506 bp, Homo sapiens
  misc_feature: HIJSMM301DR22L.22.21.B10.1.454.light.4.raw
acatacgcgtcacgaccggtgctcgatttagtgtcgtcgcaaggggggggtcgtcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccacccaggcacagcccccaaactcatgatttatgaggtcactaagcgggcctcaggggtccctgatcgcttctctggctccaagtctggcgacacggcctccctgaccgtctctgggctccaggctgaggatgaggctgattattactgctactcatatgcaggcggcaactcttgggtgttcggcggagggaccaagctgaccgtcctaggtcagcccaaggctgccccctcggtcactctcg

SEQ ID NO: 557484 - DNA, 496 bp, Homo sapiens
  misc_feature: HIJSMM301DFUM1.14.64.F09.1.454.light.4.raw
cgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagcgttatcgcctatttaaattggtatcagcaaaaaccagggaaagcccctaacctcctgatctttgatgcatccaatttgcagagtggggtcccatcacgcttcactggcagtggctctgggacagatttcactctcaccatcagcggtctccaacctgaagattttgcaacttactactgtcaacagagttatgataccccgtggacgttcggccaggggaccaaggtggaggatacaaacgaactgtggctgcaccatctgtcttcatcttcccg

SEQ ID NO: 557485 - DNA, 486 bp, Homo sapiens
  misc_feature: HIJSMM301BJBI4.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcagggtacactctggccgttcacttttggtccaggggaccaaactggatatcagacgaactgtgg

SEQ ID NO: 557486 - DNA, 483 bp, Homo sapiens
  misc_feature: HIJSMM301CGDZT.5.39.D06.1.454.light.4.raw
atcagacacgcacgaccggtgctcgatttagtgacatctcgcagttctttggggaggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccaggagaggccccaaagctccttatttatgatgcctccactttgattagtggggtcccaccaacgttcagcggcagtggatctgggacagagttcactctcaccatcagcagcctgcagcctgatgatcttggaacttattactgccaacaatataatagttattggacgttcggccaggggaccaaggtacgaaatgagacgaactgtggctgcacc

SEQ ID NO: 557487 - DNA, 444 bp, Homo sapiens; identical to SEQ ID NO: 535192
  misc_feature: HIJSMM301D0DSA.5.9.A09.1.454.light.4.raw

SEQ ID NO: 557488 - DNA, 444 bp, Homo sapiens; identical to SEQ ID NO: 535192
  misc_feature: HIJSMM301CZRQN.5.9.A09.1.454.light.4.raw

SEQ ID NO: 557489 - DNA, 511 bp, Homo sapiens
  misc_feature: HIJSMM301CEWB6.41.9.A09.1.454.light.4.raw
tctatactatcacgaccggtgctcgatttagcgagacgcgcaggggcagcttcagctgtgggtagagaagacaggactcaggacaatctccagcatggccagcttccctctcctcctcaccctcctcactcactgtgcagggtcctgggcccagtctgtcctgactcagccaccctcagcgtctgggacccccgggcagacggtgaccatctcctgttctggaagcagttccaacatcggaagtaataatgtgaattggtaccggcaactcccaggaacggcccccaaactcctcatacatagtaatgatcatcggccccctggggtccctgaccgaatctctggctccaggtctggcgcctcagcctccctggtcattagtgggctccagtctgacgatgaggctgactattactgttcagcgtgggatgccagcccgaatcattgggtgttcggcggagggaccaaactgaccgtcctaggtcagcccaaggctgccccctcggtcact

SEQ ID NO: 557490 - DNA, 508 bp, Homo sapiens; identical to SEQ ID NO: 543419
  misc_feature: HIJSMM301APWWU.4.10.A10.1.454.light.4.raw

SEQ ID NO: 557491 - DNA, 495 bp, Homo sapiens
  misc_feature: HIJSMM301BG919.11.81.H04.1.454.light.4.raw
  modified_base (404)..(404): a, c, t, g, unknown or other
cgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagttttttacngtcagcagtatagtaactggcctccgtacacttttggccaggggaccaagctagaaatcaaacgaactgtggctgcaccatctgtcttcta

SEQ ID NO: 557492 - DNA, 456 bp, Homo sapiens
  misc_feature: HIJSMM301AFO1T.49.85.H08.1.454.light.4.raw
agtcgagagacacgaccggtgctcgatttagtatcactcagtcgcgggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaattgggggataaatatgctggctggtatcagcagaagccaggccagtcccctgtgttggtcatctatcaagataccaagcggccctcagggatccctgagcgattctctggctccaactctgggaacacagccactctgaccatcagcgggactcaggctatcgatgaggctgactattactgtcaggcgtgggacagccgcactggggtattcggcggagggaccaagctgaccgt

SEQ ID NO: 557493 - DNA, 494 bp, Homo sapiens; identical to SEQ ID NO: 535276
  misc_feature: HIJSMM301B1EKH.16.6.A06.1.454.light.4.raw

SEQ ID NO: 557494 - DNA, 511 bp, Homo sapiens; identical to SEQ ID NO: 535406
  misc_feature: HIJSMM301D8972.43.59.F04.1.454.light.4.raw

SEQ ID NO: 557495 - DNA, 496 bp, Homo sapiens; identical to SEQ ID NO: 537925
  misc_feature: HIJSMM301BIW3F.22.14.B03.1.454.light.4.raw

SEQ ID NO: 557496 - DNA, 367 bp, Homo sapiens
  misc_feature: HIJSMM301DB37N.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcacta

SEQ ID NO: 557497 - DNA, 494 bp, Homo sapiens; identical to SEQ ID NO: 537272
  misc_feature: HIJSMM301ET57Z.47.78.H01.1.454.light.4.raw

SEQ ID NO: 557498 - DNA, 495 bp, Homo sapiens
  misc_feature: HIJSMM301DZ9SL.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagttgatcaccttcggccaagggacacgactggagattaaacgaactgtggctgcaccatctgtctt

SEQ ID NO: 557499 - DNA, 480 bp, Homo sapiens
  misc_feature: HIJSMM301A1DE5.51.87.H10.1.454.light.4.raw
cgatcgtatacacgaccggtgctcgatttagcagtactgcgttgggtttggggctttccctggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagagaccagggaaagcccctaacctcctgatctatgatgcatccaatttggaaagtggggtcccatcaaggttcagtggcagtggatctgggacagatttcactctcaccatcagcagtgtgcgacctgaagattttgcaacttactactgtcaacagagttacagtacccctcagctcactttcggcggagggaccaaggtggagatcaaacgaactgtggctgcaccatctgtcttcatcttcccgccat

SEQ ID NO: 557500 - DNA, 447 bp, Homo sapiens; identical to SEQ ID NO: 535201
  misc_feature: HIJSMM301CHUBI.18.9.A09.1.454.light.4.raw

SEQ ID NO: 557501 - DNA, 502 bp, Homo sapiens
  misc_feature: HIJSMM301C4WPI.43.53.E09.1.454.light.4.raw
tgtgagtagtcacgaccggtgctcgatttagagagagtgtgttggggtttggggggggtcgacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaacccca

SEQ ID NO: 557502 - DNA, 505 bp, Homo sapiens; identical to SEQ ID NO: 535503
  misc_feature: HIJSMM301D7QIP.8.28.C06.1.454.light.4.raw

SEQ ID NO: 557503 - DNA, 491 bp, Homo sapiens
  misc_feature: HIJSMM301C2LB2.19.57.F02.1.454.light.4.raw
tactctcgtgcacgaccggtgctcgatttagctcgatatagttgggtttggggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgcaacttattttgtcaacaggctaacactttccccctcactttcggcggagggaccaaggtggagatcaagcgaactgtggctgcaccatctgtctt

SEQ ID NO: 557504 - DNA, 482 bp, Homo sapiens
  misc_feature: HIJSMM301C1BHD.49.28.C06.1.454.light.4.raw
agtcgagagacacgaccggtgctcgatttagagctcacgtattgggtttggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataattactggctcgtttttggccaggggaccaagctggagatcaagcgaactgtggctgcaccat

SEQ ID NO: 557505 - DNA, 511 bp, Homo sapiens
  misc_feature: HIJSMM301CRPON.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgccccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagccaaggctcgccccctcggtcactctgttccca

SEQ ID NO: 557506 - DNA, 504 bp, Homo sapiens
  misc_feature: HIJSMM301DE8WD.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcgggcgttcggccaagggaccaaggtggaaatacaaacgaactgtggctgcaccatctgtcttcatcttccccg

SEQ ID NO: 557507 - DNA, 484 bp, Homo sapiens
  misc_feature: HIJSMM301BIHK0.46.35.D02.1.454.light.4.raw
  modified_base (365)..(365): a, c, t, g, unknown or other
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctnaccatcagcagactggagcctgaagattttgcagtctattactgtcagcagtatggtcacgtcccaagaactttggccagggaccaagctggagatcaaacgaactgtggctgcaccat

SEQ ID NO: 557508 - DNA, 495 bp, Homo sapiens; identical to SEQ ID NO: 537716
  misc_feature: HIJSMM301EQC34.22.14.B03.1.454.light.4.raw

SEQ ID NO: 557509 - DNA, 516 bp, Homo sapiens; identical to SEQ ID NO: 543380
  misc_feature: HIJSMM301CYPLS.52.67.G01.1.454.light.4.raw

SEQ ID NO: 557510 - DNA, 485 bp, Homo sapiens
  misc_feature: HIJSMM301D1KB8.49.81.H04.1.454.light.4.raw
agtcgagagacacgaccggtgctcgatttagtagtgtagattcgcgggggcaggagtcagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatctaccactcactttcggtcggagggaccacggtggaggatcaaacgaactagtggctgcacc

SEQ ID NO: 557511 - DNA, 497 bp, Homo sapiens
  misc_feature: HIJSMM301CGNTH.22.14.B03.1.454.light.4.raw
  modified_base (443)..(443): a, c, t, g, unknown or other
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttatattgtcagcaatattatattcctcctnagtacgttcggccaagggaccaaggtggaaatcaaacgaactgtggctgcacca

SEQ ID NO: 557512 - DNA, 501 bp, Homo sapiens; identical to SEQ ID NO: 535873
  misc_feature: HIJSMM301EQIJ6.17.27.C05.1.454.light.4.raw

SEQ ID NO: 557513 - DNA, 496 bp, Homo sapiens; identical to SEQ ID NO: 535109
  misc_feature: HIJSMM301AE91X.16.78.H01.1.454.light.4.raw

SEQ ID NO: 557514 - DNA, 497 bp, Homo sapiens; identical to SEQ ID NO: 536376
  misc_feature: HIJSMM301AIIPO.22.9.A09.1.454.light.4.raw

SEQ ID NO: 557515 - DNA, 484 bp, Homo sapiens; identical to SEQ ID NO: 535400
  misc_feature: HIJSMM301EU0CU.46.26.C04.1.454.light.4.raw

SEQ ID NO: 557516 - DNA, 499 bp, Homo sapiens
  misc_feature: HIJSMM301AY2YL.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccaactgaccgtcctaggtcagccaaggctgcccctc

SEQ ID NO: 557517 - DNA, 492 bp, Homo sapiens
  misc_feature: HIJSMM301CHBW5.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttatactgtcatcagagtactactttacctcaagtgatcaccttcggccaagggacacgactggagattaaacgactgtggctgcaccatctgtctt

SEQ ID NO: 557518 - DNA, 509 bp, Homo sapiens
  misc_feature: HIJSMM301BRZXI.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccgggggccactttcggccctcgggaccaaagtggatatcaaacgaactgtggctgcaccatctgtcttcta

SEQ ID NO: 557519 - DNA, 469 bp, Homo sapiens; identical to SEQ ID NO: 536091
  misc_feature: HIJSMM301BB1HT.3.82.H05.1.454.light.4.raw

SEQ ID NO: 557520 - DNA, 517 bp, Homo sapiens; identical to SEQ ID NO: 536992
  misc_feature: HIJSMM301ENCFO.22.30.C08.1.454.light.4.raw

SEQ ID NO: 557521 - DNA, 481 bp, Homo sapiens; identical to SEQ ID NO: 539249
  misc_feature: HIJSMM301B485Y.11.76.G10.1.454.light.4.raw

SEQ ID NO: 557522 - DNA, 506 bp, Homo sapiens; identical to SEQ ID NO: 539926
  misc_feature: HIJSMM301A3Y25.5.24.C02.1.454.light.4.raw

SEQ ID NO: 557523 - DNA, 521 bp, Homo sapiens; identical to SEQ ID NO: 536990
  misc_feature: HIJSMM301CEIYT.27.23.C01.1.454.light.4.raw
  modified_base (517)..(517): a, c, t, g, unknown or other

SEQ ID NO: 557524 - DNA, 486 bp, Homo sapiens
  misc_feature: HIJSMM301BSLY7.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcggtccgacgggaccgacggtggagtgtcaagcgaactgtggcgtgcacca

SEQ ID NO: 557525 - DNA, 504 bp, Homo sapiens
  misc_feature: HIJSMM301AWN8K.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaaactgaccgtcctaggtcaggcccaa

SEQ ID NO: 557526 - DNA, 497 bp, Homo sapiens; identical to SEQ ID NO: 535286
  misc_feature: HIJSMM301CJX53.18.59.F04.1.454.light.4.raw

SEQ ID NO: 557527 - DNA, 489 bp, Homo sapiens; identical to SEQ ID NO: 542061
  misc_feature: HIJSMM301AH54C.15.8.A08.1.454.light.4.raw

SEQ ID NO: 557528 - DNA, 494 bp, Homo sapiens; identical to SEQ ID NO: 534994
  misc_feature: HIJSMM301CT51I.27.78.H01.1.454.light.4.raw

SEQ ID NO: 557529 - DNA, 491 bp, Homo sapiens
  misc_feature: HIJSMM301ESI4Q.41.23.C01.1.454.light.4.raw
tctatactatcacgaccggtgctcgatttagtacacgtgattagggattggggggtccaggaggcagaactctgggtgtctcaccatggcctggatccctctacttctcccctcctcactctctgcacaggctctgtgacctcctatgagctgacacagccaccctcggtgtcagtgtccccaggacagacggccaggatcgactgctctggagaagcattggcaacggaatatgcttattggtaccagcagaagccaggtcaggcccccatgttaataatatatagagacagtgagaggccctcagggatacctgagcgtatgtctggctccagctcagggacaacagtcacgttgaccatcactggagtccaggcagaagacgaggctgactatcactgtcaatcagcagacagtagtggttcttattgggtgttcggcggagggaccaagctgaccgtccttggtcagcccaaggctgccccctcggt

SEQ ID NO: 557530 - DNA, 485 bp, Homo sapiens
  misc_feature: HIJSMM301D1O58.48.37.D04.1.454.light.4.raw
agtatacatacacgaccggtgctcgatttagtagcatactgttgggtttgggggctgtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaagg

SEQ ID NO: 557531 - DNA, 494 bp, Homo sapiens
  misc_feature: HIJSMM301DO7CR.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagcccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctactcttttctcttcggaactgggaccacggtcaccgtcctaggtcagcccaaggccaaccca

SEQ ID NO: 557532 - DNA, 478 bp, Homo sapiens; identical to SEQ ID NO: 535449
  misc_feature: HIJSMM301CGO19.40.59.F04.1.454.light.4.raw

SEQ ID NO: 557533 - DNA, 419 bp, Homo sapiens
  misc_feature: HIJSMM301DKYZN.18.59.F04.1.454.light.4.raw
tacgagtatgcacgaccggtgctcgatttagtacacacacttagggattgggggctttgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaaccccactgtcactctgttcccaccctcctccatactcgta

SEQ ID NO: 557534 - DNA, 488 bp, Homo sapiens
  misc_feature: HIJSMM301CQK4Q.43.36.D03.1.454.light.4.raw
tgtgagtagtcacgaccggtgctcgatttagctgcgtcacgatctctcttgggggagctacaacaggcaggcaggggcagcaagatggtgttgcagacccaggtcttcatttctctgttgctctggatctctggtgccttcggggacatcgtgatgacccagtctccaggttccctggctgtctctctgggcgagagggccacgctcaagtgcacctccagcgagagtgtgttgtatccccccacccatcagcacgccttagcctggtaccagcacaagtcagggcagcctcctaagttgctcttttactggacttcgatccgcgcatctggggtccctgaccgattcatgggcagcggctctgggacagacttcgctctcaccatcaacagcctccaggctgaggatgcggcggtttattattgtcaacaatattttagtgctccgtacacttttggccagggggaccaagttggagatcaaacgaa

SEQ ID NO: 557535 - DNA, 505 bp, Homo sapiens
  misc_feature: HIJSMM301BDVWM.40.60.F05.1.454.light.4.raw
tctagcgactcacgaccggtgctcgatttagtacgtcatcagggaaagggggagctgctcagttaggacccagagggaaccatggaaaccccagcgcagcttctcttcctcctgctactctggctcccagagacccccggagaaattgtgttgacgcagtctccaggcaccctgtctttgtctccaggggaaagagccaccctctcctgcagggccagtcagagtgtaaccaacaactacttaatgtggtaccagcaaaaacctggccaggctcccaggctcctcatctatggtgcatccaacagggccagtggcatcccagacaggtttagaggcagtggggccgacacagacttcactctcaccatcagcagactggagcctgaagattttgcactgtattactgtcagcagtatggtagctcaccgatcaccttcggccaagggacacgactggagattaaccgaactgtggctgcaccatctgtcttcatcttcccgccta

SEQ ID NO: 557536 - DNA, 488 bp, Homo sapiens; identical to SEQ ID NO: 536554
  misc_feature: HIJSMM301AMKF8.26.37.D04.1.454.light.4.raw

SEQ ID NO: 557537 - DNA, 486 bp, Homo sapiens; identical to SEQ ID NO: 535385
  misc_feature: HIJSMM301AQB0S.19.71.G05.1.454.light.4.raw

SEQ ID NO: 557538 - DNA, 453 bp, Homo sapiens
  misc_feature: HIJSMM301DMO17.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatcgtgggaccaaggtcaccgtcctaagtcagacccaaggcccaacccctctcgtcactctcgttccccaccctcctccatactcgta

SEQ ID NO: 557539 - DNA, 492 bp, Homo sapiens; identical to SEQ ID NO: 535126
  misc_feature: HIJSMM301EHCXL.18.11.A11.1.454.light.4.raw

SEQ ID NO: 557540 - DNA, 479 bp, Homo sapiens
  misc_feature: HIJSMM301CW7H4.48.28.C06.1.454.light.4.raw
agtatacatacacgaccggtgctcgatttagagctcacgtattgggtttggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagccccg

SEQ ID NO: 557541 - DNA, 518 bp, Homo sapiens
  misc_feature: HIJSMM301C2RCC.9.86.H09.1.454.light.4.raw
tgatacgtctcacgaccggtgctcgatttagtgctatagacttgggtttggggggggtcacaagaggcagcgctctcgggacgtctccaccatggcctgggctctgctgctcctcaccctcctcactcaggacgcagggtcctgggcccagtctgccctgactcagcctgcctccgtgtctgcgtctcctggacagtcgatcaccatctcctgcactggaaccagcattgggagttttaaccttgtctcctggtaccaacaccacccaggcaaagcccccaaactcatgatttatgaagtcactaagcggccctcggggatttctgctcgcttctctggctccaagtccgtcaacacggcctccctgacaatctctgggctccagactgaggacgaggctcattattactgttgctcatatacaggtgtaagtagttgggtgttcggcggagggaccaagctgaccgtcctaggtcagcccaaggctgccccctcggtcactctgttcccaccctcct

SEQ ID NO: 557542 - DNA, 415 bp, Homo sapiens
  misc_feature: HIJSMM301ERTTO.16.46.E02.1.454.light.4.raw
tgtactactccacgaccggtgctcgatttagactcatctacagggaaagggggctgtgcctggggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaaccccactgtcactctgttcccacctcctcgagtagtaca

SEQ ID NO: 557543 - DNA, 481 bp, Homo sapiens
  misc_feature: HIJSMM301C87BU.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgcccaggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggttttggctgttcggcggcgggacc

SEQ ID NO: 557544 - DNA, 477 bp, Homo sapiens; identical to SEQ ID NO: 536960
  misc_feature: HIJSMM301C3CP7.52.1.A01.1.454.light.4.raw

SEQ ID NO: 557545 - DNA, 509 bp, Homo sapiens
  misc_feature: HIJSMM301BCVFT.5.60.F05.1.454.light.4.raw
atcagacacgcacgaccggtgctcgatttagtacgtcatcagggaaagggggcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctggaagcacctccaacatcggaagtaatattgtaaactggtaccagcagctcccaggaacggcccccaaactcctcatctataggaataatcaacggccctcaggggtccctgaccgattctctggctccaagtctggcacctcagcctccctggccatccgtgggctccagtctgaggatgagtctgattattactgtgcaacatgggatgacagcctgaatggtccggtattcggcggagggaccaagctgaccgtctcggtcagcccaaggctgccccctcggt

SEQ ID NO: 557546 - DNA, 485 bp, Homo sapiens; identical to SEQ ID NO: 539315
  misc_feature: HIJSMM301B1L2Y.3.88.H11.1.454.light.4.raw

SEQ ID NO: 557547 - DNA, 489 bp, Homo sapiens; identical to SEQ ID NO: 538498
  misc_feature: HIJSMM301ANWUI.19.71.G05.1.454.light.4.raw

SEQ ID NO: 557548 - DNA, 495 bp, Homo sapiens
  misc_feature: HIJSMM301AXJJS.48.10.A10.1.454.light.4.raw
agtatacatacacgaccggtgctcgatttagcgtcgatctcagggggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggaccttcggtccaaggaccgacggtgggaagtacaaacgaaacctagtggtcgtgcaccaactctgtcttt

SEQ ID NO: 557549 - DNA, 486 bp, Homo sapiens; identical to SEQ ID NO: 535043
  misc_feature: HIJSMM301AK6I2.46.35.D02.1.454.light.4.raw

SEQ ID NO: 557550 - DNA, 454 bp, Homo sapiens; identical to SEQ ID NO: 536347
  misc_feature: HIJSMM301BTZ6C.19.86.H09.1.454.light.4.raw

SEQ ID NO: 557551 - DNA, 504 bp, Homo sapiens
  misc_feature: HIJSMM301COUKO.10.33.C11.1.454.light.4.raw
  modified_base (493)..(493): a, c, t, g, unknown or other
catagtagtgcacgaccggtgctcgatttagagtgagctcgttgggtttggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtccgcctcacttcggtcggggaccggacggtaggaggtactaacgaacgtaatggcgtgcaccactactnttcttctactt

SEQ ID NO: 557552 - DNA, 527 bp, Homo sapiens
  misc_feature: HIJSMM301AFC5D.43.67.G01.1.454.light.4.raw
tgtgagtagtcacgaccggtgctcgatttagagtatacatattgggtttgggggagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgttatactccgccgacgttcggtccggggaccggaccgtcggaaagtacaaacgaaaccgtacgtgggtcgtcggcacccactcctgtcttt

SEQ ID NO: 557553 - DNA, 488 bp, Homo sapiens; identical to SEQ ID NO: 536861
  misc_feature: HIJSMM301BWOEC.12.88.H11.1.454.light.4.raw

SEQ ID NO: 557554 - DNA, 508 bp, Homo sapiens
  misc_feature: HIJSMM301A0QRV.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaaatttataaaggtttccaaccgggactctggggtcccagacagattcagcggcagtgggtcaggcactgatttcacactggaaatcagcagggtggaggctgaggatgttggggtttattatgcatgcaaaactacacacggccgctcactttcggcggagggaccaaggtggagatcaaacgaactgtggctgcaccatctgtt

SEQ ID NO: 557555 - DNA, 522 bp, Homo sapiens
  misc_feature: HIJSMM301DNW73.41.25.C03.1.454.light.4.raw
tctatactatcacgaccggtgctcgatttagtagtgtagatttgggtttgggcacgaccggtgctcgatttagtagtgtagatttgggtttgggggatagctcaggaagcagagcctggagcatctccactatggcctgggctccactacttctcaccctcctcgctcactgcacaggttcttgggcccatttttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctggggtcccctttcggttttctggctccatcgacagtccctccaactccgcctcccttaccatatctgggctgaagagtgaggacgaggctgactacttctgtcagtcttatgatataaacaattatgtgataattggcggagggaccagggtgaccgtccta

SEQ ID NO: 557556 - DNA, 486 bp, Homo sapiens
  misc_feature: HIJSMM301D6BM8.47.46.E02.1.454.light.4.raw
agctcacgtacacgaccggtgctcgatttagactcatctacagggaaaggggaggaactgctcagttaggacccagacggaaccatggaagccccagcgcagcttctcttcctcctgctactctggctcccagagaccactggagaaatagtgatgacgcagtctccagccaccctgtctgtctctccaggggaaagagccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctgaagtattttgctagtttattactgtcagcagtatcataactggccgctcaccttcggccaagggacacgactggagattaaacgaactgtggctgcaccat

SEQ ID NO: 557557 - DNA, 433 bp, Homo sapiens; identical to SEQ ID NO: 535093
  misc_feature: HIJSMM301BP1WM.18.5.A05.1.454.light.4.raw

SEQ ID NO: 557558 - DNA, 495 bp, Homo sapiens; identical to SEQ ID NO: 543912
  misc_feature: HIJSMM301AEY5S.12.38.D05.1.454.light.4.raw

SEQ ID NO: 557559 - DNA, 489 bp, Homo sapiens
  misc_feature: HIJSMM301ESUZJ.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattctccagcgttcggccagggaccaacggtggaagtcaagcgaactgtggctgcaccatctgtt

SEQ ID NO: 557560 - DNA, 499 bp, Homo sapiens
  misc_feature: HIJSMM301BO4I7.11.67.G01.1.454.light.4.raw
  modified_base (488)..(488): a, c, t, g, unknown or other
cgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagccaccctcagcgtctgggacccccgggcagagaatcaccatctcttgtactggaagcagctccaatatcggaagtaacgatgtcaattggtatcaacatctccccggtacggcccccaaactcctcatctataggaatagccagcggccctcaggggtccctggccgattctctggctcgaagtctggcacctcagccctccctggcctgcagtgggctccagtctgaggatgaggctgactattattgtgcagcgtgggatgacggtctgagtgctgtggtcttcggcggagggaccaagctgaccgtccnggtcagcccaa

SEQ ID NO: 557561 - DNA, 485 bp, Homo sapiens; identical to SEQ ID NO: 535501
  misc_feature: HIJSMM301CL9CQ.3.10.A10.1.454.light.4.raw

SEQ ID NO: 557562 - DNA, 520 bp, Homo sapiens; identical to SEQ ID NO: 537173
  misc_feature: HIJSMM301BEYH0.27.23.C01.1.454.light.4.raw

SEQ ID NO: 557563 - DNA, 506 bp, Homo sapiens
  misc_feature: HIJSMM301DDR0H.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtaggaaatcaaacgaactagtggctgcacccatctgtcttctatcttccccg

SEQ ID NO: 557564 - DNA, 491 bp, Homo sapiens
  misc_feature: HIJSMM301EKS0Q.51.38.D05.1.454.light.4.raw
cgatcgtatacacgaccggtgctcgatttagtatctgatagttgggtttggggggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggatccctgagcgattctctggctccaactctgggaacacagccactctgaccatcagcgggacgcaggctgtggatgaggctgacttttactgtcaggcgtgggacagcgacactgccgtgttcggcgggggaccaagctgaccgtcctcggtcagcccaaggctgccccctcggtcact

SEQ ID NO: 557565 - DNA, 503 bp, Homo sapiens; identical to SEQ ID NO: 535140
  misc_feature: HIJSMM301CWYUG.18.37.D04.1.454.light.4.raw

SEQ ID NO: 557566 - DNA, 507 bp, Homo sapiens; identical to SEQ ID NO: 535641
  misc_feature: HIJSMM301DBDM7.10.88.H11.1.454.light.4.raw

SEQ ID NO: 557567 - DNA, 509 bp, Homo sapiens; identical to SEQ ID NO: 535670
  misc_feature: HIJSMM301C350C.47.23.C01.1.454.light.4.raw

SEQ ID NO: 557568 - DNA, 484 bp, Homo sapiens; identical to SEQ ID NO: 535240
  misc_feature: HIJSMM301B7S80.47.60.F05.1.454.light.4.raw

SEQ ID NO: 557569 - DNA, 495 bp, Homo sapiens; identical to SEQ ID NO: 535821
  misc_feature: HIJSMM301CKUTZ.3.31.C09.1.454.light.4.raw

SEQ ID NO: 557570 - DNA, 497 bp, Homo sapiens
  misc_feature: HIJSMM301CEHYX.11.75.G09.1.454.light.4.raw
cgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccggttatggtatgctctggtatcaacaacgtccaggaatggcccccaaactcctcatctatgctgacaacaatcgaccttcagggtccctgaccggttctctggctccaagtctggctcttccgcctccttggccatcactgggctcgaggctgacgatgaggctgattactactgtctgtcctatgacgacgacctacagactccggttttcggcggagggactaagctgaccgtcctaagtcagccca

SEQ ID NO: 557571 - DNA, 503 bp, Homo sapiens
  misc_feature: HIJSMM301BP99H.18.11.A11.1.454.light.4.raw
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaagggtggagatcaaaacgaactgtggctgcaccatctgtctt

SEQ ID NO: 557572 - DNA, 493 bp, Homo sapiens; identical to SEQ ID NO: 540693
  misc_feature: HIJSMM301DE085.22.65.F10.1.454.light.4.raw

SEQ ID NO: 557573 - DNA, 497 bp, Homo sapiens
  misc_feature: HIJSMM301EFHLL.51.35.D02.1.454.light.4.raw
cgatcgtatacacgaccggtgctcgatttagcacacgatagttgggtttgggggtgggtccaggaggcagaactctgggtgtctcaccatggcctggatccctctacttcctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcact

SEQ ID NO: 557574 - DNA, 529 bp, Homo sapiens
  misc_feature: HIJSMM301E3FYC.12.71.G05.1.454.light.4.raw
atacgacgtacacgaccggtgctcgatttagtgtcgtcgcaagagagagggggggggtcgacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctacatatggaggttatagcacttgggtgttcggcggcgggaccaaagtgaccgtcctaagtcacgcccaacggctcgccccctccggtcacctctgttccccaccct

SEQ ID NO: 557575 - DNA, 493 bp, Homo sapiens; identical to SEQ ID NO: 535745
  misc_feature: HIJSMM301E0MT9.47.78.H01.1.454.light.4.raw

SEQ ID NO: 557576 - DNA, 460 bp, Homo sapiens; identical to SEQ ID NO: 539553
  misc_feature: HIJSMM301AN4IR.11.86.H09.1.454.light.4.raw

SEQ ID NO: 557577 - DNA, 479 bp, Homo sapiens
  misc_feature: HIJSMM301C3EUF.41.17.B06.1.454.light.4.raw
tctatactatcacgaccggtgctcgatttagtcgatagtgaagggggaactgctcagttaggacccagacgggaccatggaagccccagcgcagcttctcttcctcctgctactctggctcccagatatcacaggagagatagtgatgacgcagtctccagccaccctgtctctgtctccaggggaaagagcctccctctcctgcagggccagtcagaatattcgcggccacttagcctggtatcagcagaaacctggccaggctcccaggctcctcatctatgctgcatccaccagggccactggtatcccagccaggttcagtggcggtgggtctgggacagagtttactctcaccatcaacggcctgcagtctgaagattctgcagtttattactgtcagcagtatgttgactggcctccgctcactttcggcggagggaccaaggtggagatcagacgaactgtggctgcaccat

SEQ ID NO: 557578 - DNA, 528 bp, Homo sapiens
  misc_feature: HIJSMM301BCEGN.5.27.C05.1.454.light.4.raw
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaacccacctcgtcacttctcgttcccgtcccctccctccgtcgtcg

SEQ ID NO: 557579 - DNA, 518 bp, Homo sapiens
  misc_feature: HIJSMM301E3IY9.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaaagcggggacccagaccctggagcctcagttggaagcagccgatccagcctgcggagcctgtgggcaggtcagcccaaggctgccccctcggtcactctgttcccaccctcctccacg

SEQ ID NO: 557580 - DNA, 493 bp, Homo sapiens; identical to SEQ ID NO: 535047
  misc_feature: HIJSMM301B4J6T.16.53.E09.1.454.light.4.raw

SEQ ID NO: 557581 - DNA, 504 bp, Homo sapiens
  misc_feature: HIJSMM301CA02A.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccgacaatccggggtccctgaccgattcagtggcagcgggtctgggacagatttcactctcaccatcagcagcctgcaggctgaagatgtggcagtttattactgtcaacagttttctcgggcgttcggccaagggaccaaggtggaaatacaaacgaactagtggctgcaccatctgtcttcatcttccccg

SEQ ID NO: 557582 - DNA, 444 bp, Homo sapiens; identical to SEQ ID NO: 535027
  misc_feature: HIJSMM301DVXG9.8.73.G07.1.454.light.4.raw

SEQ ID NO: 557583 - DNA, 454 bp, Homo sapiens; identical to SEQ ID NO: 534964
  misc_feature: HIJSMM301CWTYJ.19.86.H09.1.454.light.4.raw

SEQ ID NO: 557584 - DNA, 506 bp, Homo sapiens; identical to SEQ ID NO: 551204
  misc_feature: HIJSMM301D2QJF.15.59.F04.1.454.light.4.raw

SEQ ID NO: 557585 - DNA, 468 bp, Homo sapiens
  misc_feature: HIJSMM301B85E6.49.27.C05.1.454.light.4.raw
agtcgagagacacgaccggtgctcgatttagacgcgatcgaagggtttgggggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctcccgctcactttcggcgggggaccgaaggtggagatcaagcgaa

SEQ ID NO: 557586 - DNA, 504 bp, Homo sapiens
  misc_feature: HIJSMM301AGWI9.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgtcggtccaaggaccaaggtaggaatacaaacgaactatggctgcaccactctgtcttctatcttccccg

SEQ ID NO: 557587 - DNA, 494 bp, Homo sapiens; identical to SEQ ID NO: 535629
  misc_feature: HIJSMM301DOT1E.4.27.C05.1.454.light.4.raw

SEQ ID NO: 557588 - DNA, 508 bp, Homo sapiens
  misc_feature: HIJSMM301AJN0S.47.55.E11.1.454.light.4.raw
agctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctaggtcagcccaaggcccaacccc

SEQ ID NO: 557589 - DNA, 483 bp, Homo sapiens
  misc_feature: HIJSMM301ASX4W.49.83.H06.1.454.light.4.raw
agtcgagagacacgaccggtgctcgatttagatcacgtgcgtcgcgggggatcaggacttctcagttcatcttctcaccatgaggctccctgctcagctcctggggctgccaatgctctggaaacctgggtccagtgcggatattgtgatgacccagactccactctttctgtccgtcacccctggacagccggcctccatctcctgcaagtctagtcagaccctccagcatagtcttggcaagacctatttccatagtcacctgcacaagccaggccagcctccacaggtcctgatctatgatgtttccagccggttctctggagtggcggatgggttcagtggcagcgagtcagggccaggcttcacactgaaaatcagccgggtggaggctgaggatgttggggtttattattgcatgcagaggatagagatccctccgagacttttggccaggggaccgagctggagatcaaacgaact

SEQ ID NO: 557590 - DNA, 489 bp, Homo sapiens
  misc_feature: HIJSMM301D0O85.52.45.E01.1.454.light.4.raw
cgcagtacgacacgaccggtgctcgatttagtgagtcagtaagggaaagggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggcaccaacagtgattttggtggttatgattctgtcttctggtaccaacggcacccaggcaaagtccccaaactcatgattactgatatcaaataagaggccctcaggggtccctgatcgcttctctggctccaagtctggcaacacggcctccctgaccatctctgggctccaggctgaggatgaggctgaatatttctgctgctcatatgcaggcggctacacttatgtcttcggaactgggaccaggtcacgtcctaggtcaggcccaagg

SEQ ID NO: 557591 - DNA, 501 bp, Homo sapiens; identical to SEQ ID NO: 535873
  misc_feature: HIJSMM301ERCLP.17.27.C05.1.454.light.4.raw

SEQ ID NO: 557592 - DNA, 406 bp, Homo sapiens
  misc_feature: HIJSMM301EZ7SE.43.34.D01.1.454.light.4.raw
tgtgagtagtcacgaccggtgctcgatttagatcgtctgtgttgggtttgggggctttgcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtcagcccaaggccaaccccactgtcactctgttcccgccctcctcactactcaca

SEQ ID NO: 557593 - DNA, 492 bp, Homo sapiens
  misc_feature: HIJSMM301BKXAA.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacacgtacccccctctactttcggcggagggaccgaaggcggagatcagacgaactgtggctgcaccatctgtcttcta

SEQ ID NO: 557594 - DNA, 354 bp, Homo sapiens; identical to SEQ ID NO: 540485
  misc_feature: HIJSMM301AF65I.40.9.A09.1.454.light.4.raw

SEQ ID NO: 557595 - DNA, 444 bp, Homo sapiens; identical to SEQ ID NO: 535192
  misc_feature: HIJSMM301A3DBY.5.9.A09.1.454.light.4.raw

SEQ ID NO: 557596 - DNA, 482 bp, Homo sapiens; identical to SEQ ID NO: 540521
  misc_feature: HIJSMM301ADHWM.21.25.C03.1.454.light.4.raw

SEQ ID NO: 557597 - DNA, 485 bp, Homo sapiens; identical to SEQ ID NO: 536576
  misc_feature: HIJSMM301CQZL8.46.35.D02.1.454.light.4.raw

SEQ ID NO: 557598 - DNA, 444 bp, Homo sapiens; identical to SEQ ID NO: 535192
  misc_feature: HIJSMM301B2NWZ.5.9.A09.1.454.light.4.raw

SEQ ID NO: 557599 - DNA, 506 bp, Homo sapiens; identical to SEQ ID NO: 545686
  misc_feature: HIJSMM301A7TPW.18.37.D04.1.454.light.4.raw

SEQ ID NO: 557600 - DNA, 460 bp, Homo sapiens
  misc_feature: HIJSMM301C5K8W.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatggggattacaacctgagtgatcctagttgggtgttcggcggagggaccaggctgaccgtcctaggtcagccaaggctgccccctcggtcactctgttcccgccctcctcacgcgtatgt

SEQ ID NO: 557601 - DNA, 495 bp, Homo sapiens
  misc_feature: HIJSMM301A7U12.4.33.C11.1.454.light.4.raw
agcactgtagcacgaccggtgctcgatttagagtgagctcgttggggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggacttcggtcggagggaccgaacggtaggagatacaaacgaaccta

SEQ ID NO: 557602 - DNA, 472 bp, Homo sapiens
  misc_feature: HIJSMM301BJC56.11.17.B06.1.454.light.4.raw
cgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccgggcaagtcagatcattagcagctatttaaattggtatcagcagaaaccagggaaagcccctgaggtcctgatctatgctgcatccagtttgcagagtggggtcccatcaaggttcagtggcagtggatctgcgacagatttcactctcaccatcagcagtctgcaacctgaagattttgcaacttactactgtcaacagattacagtaccccgtggacgttcggccaagggaccaaggtggaaatcaaacgaactagtgg

SEQ ID NO: 557603 - DNA, 509 bp, Homo sapiens; identical to SEQ ID NO: 539359
  misc_feature: HIJSMM301AZ9ZI.47.85.H08.1.454.light.4.raw

SEQ ID NO: 557604 - DNA, 483 bp, Homo sapiens; identical to SEQ ID NO: 547051
  misc_feature: HIJSMM301BSD4P.46.26.C04.1.454.light.4.raw

SEQ ID NO: 557605 - DNA, 487 bp, Homo sapiens
  misc_feature: HIJSMM301A3W8L.19.71.G05.1.454.light.4.raw
tactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatcgaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagagaa

SEQ ID NO: 557606 - DNA, 492 bp, Homo sapiens
  misc_feature: HIJSMM301BMJL6.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcggtccgacgggaccgaccggtcggagtgtctaagcgaactcgtggcgtgcaccact

SEQ ID NO: 557607 - DNA, 489 bp, Homo sapiens
  misc_feature: HIJSMM301DJAD6.11.28.C06.1.454.light.4.raw
cgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggtttcagcagaggccaggccaatctccaaggcgcctaatttataaggtttctaggcgggactctggggtcccagacagattcagcggcagtgggtcaggcgctgatttcacactgagaatcagcagggtggaggctgaagatgtcggggtttattactgcatgcagggtacagtgtggccttcgctcgcattcggcggagggaccgaaggtggaggatcaacgaa

SEQ ID NO: 557608 - DNA, 490 bp, Homo sapiens; identical to SEQ ID NO: 538273
  misc_feature: HIJSMM301AJPW5.16.73.G07.1.454.light.4.raw

SEQ ID NO: 557609 - DNA, 497 bp, Homo sapiens
  misc_feature: HIJSMM301AXNXA.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccctcggtcactctgttcccaccctccctcgagtgcgtct

SEQ ID NO: 557610 - DNA, 492 bp, Homo sapiens
  misc_feature: HIJSMM301C09JZ.4.34.D01.1.454.light.4.raw
  modified_base (432)..(432): a, c, t, g, unknown or other
agcactgtagcacgaccggtgctcgatttagatcgtctgtgttgggtttggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgcttactggtaccagcagaagccaggccaggcccctgtgttgttgttatataaagacagtgagaggccctcagggatccctgagcgattctctggctccagctcagggacaacagtcacgttgaccatcagtggagtccaggcagaagacgaggctgactattactgtcaatcagcagacagcggtgggacttanaaagagttcggcggagggaccaagctgaccgtcctaggtcagcccaggctcgtccccccg

SEQ ID NO: 557611 - DNA, 501 bp, Homo sapiens; identical to SEQ ID NO: 536867
  misc_feature: HIJSMM301A0EMK.5.86.H09.1.454.light.4.raw

SEQ ID NO: 557612 - DNA, 513 bp, Homo sapiens
  misc_feature: HIJSMM301AI9WU.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcggggcgttcggccgaagggaccgaaggtaggaaagtacaaacgaactagtggcgtgcaccatctgtcttctactcttccccg

SEQ ID NO: 557613 - DNA, 475 bp, Homo sapiens
  misc_feature: HIJSMM301A0OPK.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctactgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctcctccgagtgccacttttggcggggggacaaggtggacatcaaacgaactgt

SEQ ID NO: 557614 - DNA, 516 bp, Homo sapiens
  misc_feature: HIJSMM301AI0MA.40.27.C05.1.454.light.4.raw
tctagcgactcacgaccggtgctcgatttagacgcgatcgaagggtttggggcagcttcagctgtggtggagaagacaggattcaggccaatctccagcatggccggcttccctctcctcctcaccctcctcactcactgtgcagggtcctgggcccagtctgtgctgactcagccaccctcagcgtctgagacccccgggcagcaggttaccgtctcttgttctggaagcagctccaacatcggaagtaattctgtatactggtaccagtgcctcccaggaacggcccccaaacttctcgtctatagggattatcagcggcccttaggggtccctgaccgattctctggctccaggtctggcacctcagcctccctggccatcagtgggctccggcccgaggatgaggcggattattattgtgtgtcatgggatgacagaatgaatggtccggtgttcggcggagggaccaggctgaccgtcctaggtcagcccaaggctgccccctcggtcact

SEQ ID NO: 557615 - DNA, 447 bp, Homo sapiens; identical to SEQ ID NO: 535201
  misc_feature: HIJSMM301B4SIT.18.9.A09.1.454.light.4.raw

SEQ ID NO: 557616 - DNA, 475 bp, Homo sapiens
  misc_feature: HIJSMM301ANNC8.5.15.B04.1.454.light.4.raw
atcagacacgcacgaccggtgctcgatttagacagtatatatccgcgggggtcagactcagtcaggacacagcatggacatgagggtccccgctcagctcctggggctcctgctgctctggctcccaggtgccaaatgtgacatccagatgacccagtctccttccaccctgtctgcatctataggagacagagtcaccatcacttgccgggccagtcagagtattagtaactggttggcctggtatcagcagaaaccaggcaaagccccaaagctccttatctctgatgcctccactttgcacggtggggtcccaccaacgttcagcggcagtggatctgggacagaattcactctcaccatcagcagcctgcagcctgatgatgctgcaacttattactgtcaacaatataacagttattggacgttcggccaagggaccaaggtggaaatcaaacgaactagtggctgcacc

SEQ ID NO: 557617 - DNA, 488 bp, Homo sapiens
  misc_feature: HIJSMM301BWO28.48.10.A10.1.454.light.4.raw
agtatacatacacgaccggtgctcgatttagcgtcgatctcagggggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggaccttcggccagggaccgacggtggaaagtacaaacgaactagtggcgtgcaccatctgtctt

SEQ ID NO: 557618 - DNA, 503 bp, Homo sapiens; identical to SEQ ID NO: 547911
  misc_feature: HIJSMM301D2D5P.7.31.C09.1.454.light.4.raw

SEQ ID NO: 557619 - DNA, 513 bp, Homo sapiens; identical to SEQ ID NO: 535244
  misc_feature: HIJSMM301CD23F.17.33.C11.1.454.light.4.raw

SEQ ID NO: 557620 - DNA, 488 bp, Homo sapiens
  misc_feature: HIJSMM301ANVOD.26.45.E01.1.454.light.4.raw
agactatactcacgaccggtgctcgatttagtgagtcagtaagggaaaggggtgatcaggactcctcagttcaccttctcacaatgaggctccctgctcagctcctggggctgctaatgctctgggtctctggatccagtggagatattgtgatggctcagtctccactctccctgcccgtcacccctggagagccggcctccatctcctgcaggtctagtcagagcgtcctgcatagtagtggatacaactatttggattggtacctgcagaagccagggcagtctccacagctcctgatctatttggcttctaatcgggcctccggggtccctgacaggttcaatggcagtggatcagacacagattttacactgaaaatcagtagagtggaggctgaggatgttggagtttattactgcatgcaagctctacaaactcctctcactttcggcggagggaccaaggtggagatcaaacgaaactgt

SEQ ID NO: 557621 - DNA, 489 bp, Homo sapiens
  misc_feature: HIJSMM301BETI7.13.87.H10.1.454.light.4.raw
tcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagcaaaaaccagggaaagtccctaagctcctgatctatgttgcatccactttgcaaagtggggtcccatcaaggttcagcggcagtggatctgggacagaattcactctcacaatcagcagcctgcagcctgaagattttgcaacttattactgtcaacagcttaatagttacccgctcagtttcggcggagggaccaaggtggagatcaaacgaactgtggctgcaccatctgtcttcta

SEQ ID NO: 557622 - DNA, 489 bp, Homo sapiens
  misc_feature: HIJSMM301AJ4JV.40.69.G03.1.454.light.4.raw
tctagcgactcacgaccggtgctcgatttagtcgctgcgtaaaggagaaagggggaggaactgctcagttaggacccagacggaaccatggaagccccagcgcagcttctcttcctcctgctactctggctcccagatagcgctggagaaatagtgatgacgcagtctccagccaccctgtctgtgtctccagggaaaagagccaccctctcctgcagggccagtgagagtgttgacacctacttagcctggtaccaacacagacctggccaggctcccacggctcctcatctctggtgcatccacccgggccactggtatcccagtcaggttcagtggcagtgggtctgggacagagttcactctcaccatcagcagcctgcagtctgaagatgttgcagtttattcctgtcagcagtacaatgactggccggtacacttttggccaggggaccaagctggagatcaaacgaactgtggctgcaccat

SEQ ID NO: 557623 - DNA, 493 bp, Homo sapiens; identical to SEQ ID NO: 535084
  misc_feature: HIJSMM301CMB1B.47.64.F09.1.454.light.4.raw

SEQ ID NO: 557624 - DNA, 445 bp, Homo sapiens
  misc_feature: HIJSMM301DCQ5O.14.76.G10.1.454.light.4.raw
cgtctagtaccacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccatcaggtcccaggaacggcccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatggcaattgggtattcggcggagggaccaagttgaccgtcctaagtcagcccaaggctgccccctcggtcactctgttccccgccctcctcgtactagacg

SEQ ID NO: 557625 - DNA, 471 bp, Homo sapiens
  misc_feature: HIJSMM301EAPPY.3.38.D05.1.454.light.4.raw
agacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtgggtcccatcaaggttcagtggcagtggatctgggacagatttcactctcaccatcaacagtctgcaacctgaagattttgcaacttactactgtcaacagagtttcactacccctctcactttcggcgggggaccaaggtggagatcaaacgaa

SEQ ID NO: 557626 - DNA, 494 bp, Homo sapiens; identical to SEQ ID NO: 553467
  misc_feature: HIJSMM301AFHX3.13.67.G01.1.454.light.4.raw

SEQ ID NO: 557627 - DNA, 361 bp, Homo sapiens; identical to SEQ ID NO: 544890
  misc_feature: HIJSMM301C6FKW.3.57.F02.1.454.light.4.raw

SEQ ID NO: 557628 - DNA, 479 bp, Homo sapiens; identical to SEQ ID NO: 535118
  misc_feature: HIJSMM301DXJ51.13.59.F04.1.454.light.4.raw

SEQ ID NO: 557629 - DNA, 503 bp, Homo sapiens
  misc_feature: HIJSMM301DGTRQ.41.45.E01.1.454.light.4.raw
tctatactatcacgaccggtgctcgatttagtgagtcagtaagggaaagggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccgaagctgaccgtcctaggtcagcccaaggctgccccctcggtccactcc

SEQ ID NO: 557630 - DNA, 506 bp, Homo sapiens
  misc_feature: HIJSMM301DW5HU.43.24.C02.1.454.light.4.raw
tgtgagtagtcacgaccggtgctcgatttagtacagatcgttagggaaagggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggttattataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattattgcagttcatatacaagcagcaccactattatgtcttcggagctgggaccaaggtcaccgtcctaggtcagcccaaggccaaccccactgt

SEQ ID NO: 557631 - DNA, 519 bp, Homo sapiens
  misc_feature: HIJSMM301DVC7A.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaaacaggtttttctcggggcgttcggtccgaagggaccgaaggtaggaaagtacgaaacgaaacgtgtggcgtgcgaccaactctgtcttcatcttccccg

SEQ ID NO: 557632 - DNA, 486 bp, Homo sapiens
  misc_feature: HIJSMM301C7NZQ.48.81.H04.1.454.light.4.raw
agtatacatacacgaccggtgctcgatttagtagtgtagattcgcggggtccaaacagagcttcagcaagcatagtgggaatctgcaccatgccctgggctctgctcctcctgaccctcctcactcactctgcagtgtcagtggtccaggcagggctgactcagccaccctcggtgtccaagggcttgagacagaccgccacaatcacctgcactgggaacaacaataatgtcgccaaccaaggagcagcttggctgcagcagcaccagggccaccctcccaaagtcgtatccgacagggataacaatcggcccttagggatctcagagagaatatctgcatccaggtcaggaaacacagcctccctgaccattactggactccaacctgaggacgaggctgactattattgctcagcatgggacaccagcctcaatgccgcggtattcggcgcagggaccaagctgaccgtcctaggtcagcccc

SEQ ID NO: 557633 - DNA, 494 bp, Homo sapiens; identical to SEQ ID NO: 535478
  misc_feature: HIJSMM301DDEC8.10.79.H02.1.454.light.4.raw

SEQ ID NO: 557634 - DNA, 445 bp, Homo sapiens; identical to SEQ ID NO: 555301
  misc_feature: HIJSMM301AJ957.5.9.A09.1.454.light.4.raw

SEQ ID NO: 557635 - DNA, 501 bp, Homo sapiens; identical to SEQ ID NO: 536142
  misc_feature: HIJSMM301DBI6S.15.1.A01.1.454.light.4.raw

SEQ ID NO: 557636 - DNA, 490 bp, Homo sapiens
  misc_feature: HIJSMM301AF0FP.51.29.C07.1.454.light.4.raw
cgatcgtatacacgaccggtgctcgatttagagtgctacgaagggaaagggggaggaactgctcagtcaggacccagacggaaccacggaagccccagcgcagcttctcttcctcctgctactctggctcccagatactactggagaaatagtgatgacgcagtctccagccacgctgtctgtgtctccaggggaaagagccaccctctcctgcagggccagtcagagtgttaacaacaacttagcctggtatcagcagaaacctggccaggctcccaggctcctcatctttggatcatccatcagggccactggtgtcccagaaagttcagtggcggtgggtctgacacagagtacaccctcaccatcagcaccctgcagtctgaagatgtcgcagtttattactgtcaacaatatagtgacaggccgccatggacgttcggccaagggaccaggtggaatgaaggactgtgctgcacatctgtctcta

SEQ ID NO: 557637 - DNA, 520 bp, Homo sapiens; identical to SEQ ID NO: 535686
  misc_feature: HIJSMM301BG2Q2.41.19.B08.1.454.light.4.raw

SEQ ID NO: 557638 - DNA, 512 bp, Homo sapiens
  misc_feature: HIJSMM301C08GE.7.87.H10.1.454.light.4.raw
  modified_base (483)..(483): a, c, t, g, unknown or other
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgccaggacgaacgtaggaagtacgaacgaacagtggcgtgcaccacnctgtcttcactcttcccgtccactctgat

SEQ ID NO: 557639 - DNA, 484 bp, Homo sapiens
  misc_feature: HIJSMM301COQXS.51.30.C08.1.454.light.4.raw
cgatcgtatacacgaccggtgctcgatttagtctgacgtcaaagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaagcggccctcggggatacctgagcgattctctggctccacctctgggaacacagccactctgaccatcagcgggacgcaggctgtggatgaggctgacttttactgtcaggcgtgggacgagcgacactgccgtgttcggcggagggaccaagctgaccgtcctcggtcagcccaaggctccg

SEQ ID NO: 557640 - DNA, 494 bp, Homo sapiens; identical to SEQ ID NO: 542264
  misc_feature: HIJSMM301B19RQ.13.6.A06.1.454.light.4.raw

SEQ ID NO: 557641 - DNA, 512 bp, Homo sapiens
  misc_feature: HIJSMM301BHCMI.13.53.E09.1.454.light.4.raw
tcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgtcgtccaacggaccgaacggtaggaaagtacgaagacgaactacgtggcgtgcgaccactactgtcttctatt

SEQ ID NO: 557642 - DNA, 483 bp, Homo sapiens
  misc_feature: HIJSMM301AT26B.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacacccctgcgtggttttggtctgttcggcggcgggacc

SEQ ID NO: 557643 - DNA, 504 bp, Homo sapiens
  misc_feature: HIJSMM301BM9X2.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttgccgaaggaccaaggtggaaagtacaaacgaactagtggctgcaccatctgtcttcactcttccccg

SEQ ID NO: 557644 - DNA, 483 bp, Homo sapiens
  misc_feature: HIJSMM301CKUJ5.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatctccccactttcggcctggaccaaagtggatatcaaacgaactgtggctgcacatctgtt

SEQ ID NO: 557645 - DNA, 498 bp, Homo sapiens
  misc_feature: HIJSMM301D8MEX.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttccgcggcagtggatctgggacagaattcactctcactatcaccagcctgcaacctgatgattttgcaacttattactgccaacagtatcatcatcattgtaatttcggtggagggaccaaggtggaggtcaaacgaactgtggctgcaccatctgtcttcatcttccccg

SEQ ID NO: 557646 - DNA, 444 bp, Homo sapiens
  misc_feature: HIJSMM301D4QHT.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctgccccctcggtcactcctgttaccgccctcctcctgtctgat

SEQ ID NO: 557647 - DNA, 517 bp, Homo sapiens
  misc_feature: HIJSMM301A5C41.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgaattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctcgccccctcggtcactctcgttccccg

SEQ ID NO: 557648 - DNA, 494 bp, Homo sapiens; identical to SEQ ID NO: 534994
  misc_feature: HIJSMM301AW0WF.27.78.H01.1.454.light.4.raw

SEQ ID NO: 557649 - DNA, 496 bp, Homo sapiens; identical to SEQ ID NO: 553382
  misc_feature: HIJSMM301CQC4K.51.59.F04.1.454.light.4.raw

SEQ ID NO: 557650 - DNA, 486 bp, Homo sapiens
  misc_feature: HIJSMM301B9W3U.14.53.E09.1.454.light.4.raw
cgtctagtaccacgaccggtgctcgatttagagagagtgtgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgctttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttatcgggtgttcggcggagggaccaagctgaccgtcctaggtcagcccaaggctcgccccctcggtcta

SEQ ID NO: 557651 - DNA, 490 bp, Homo sapiens; identical to SEQ ID NO: 544667
  misc_feature: HIJSMM301CO9LF.12.23.C01.1.454.light.4.raw

SEQ ID NO: 557652 - DNA, 511 bp, Homo sapiens
  misc_feature: HIJSMM301CNYYV.43.83.H06.1.454.light.4.raw
tgtgagtagtcacgaccggtgctcgatttagatcacgtgcgtcgcgggggctgctcagttaggacccagagggaaccatggaaaccccagcgcagcttctcttcctcctgctactctggctcccagataccaccggagaaactgtgttgacgcagtctccaggcacgctgtctttgtctccaggggaaagagccaccctctcgtgtagggccagtcagagtgttatcaccgactccttagcctggtaccagcagaaacctggccaggctcccaggctcctcatatatggtgcatccagcaggatcactggcatcccagcgaggttcagtggccatgggtctgggacggagttcactctcaccatcagccgactggagcctgaagattttgcagtatattactgtcaacaatatgtagttctcctctcacttcgtcggagggacgaacggtaggtaaggtacgaaacgaacctaagtggtcgtgcaccaactctcgtcttctatcttcccgt

SEQ ID NO: 557653 - DNA, 494 bp, Homo sapiens
  misc_feature: HIJSMM301D96CU.16.6.A06.1.454.light.4.raw
  modified_base (395)..(395): a, c, t, g, unknown or other
tgtactactccacgaccggtgctcgatttagatctactgacagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagcttggtaccagcagaaaccggggcagtctcctaagttgctcatttactgggcgtctacccgggaatccggggtccctgaccgattcagtggcagcgggtctgggacagatttcactctcaccatcagcagcctgcaggttnaagatgtggcagtttattactgtcagcagtattatactactcctctgacgttcggccaagggaccaaggtggagatcaaacgaactgtggctgcaccat

SEQ ID NO: 557654 - DNA, 502 bp, Homo sapiens
  misc_feature: HIJSMM301CF0T8.9.12.B01.1.454.light.4.raw
  modified_base (428)..(428): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttatactgtcaacagttttcncgggcgtcggccaagggaccaaggtggaaagtcaaacgaactagtggctgcaccatctgtcttcatcttccccg

SEQ ID NO: 557655 - DNA, 471 bp, Homo sapiens
  misc_feature: HIJSMM301BRXUN.5.34.D01.1.454.light.4.raw
atcagacacgcacgaccggtgctcgatttagatcgtctgtgttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttccctccgaccttcggccaagggacacgactgagataaacgaa

SEQ ID NO: 557656 - DNA, 494 bp, Homo sapiens
  misc_feature: HIJSMM301EUOJM.22.5.A05.1.454.light.4.raw
acatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaagagccaccctctcctgcagggccagtcagagtgttaactactacttagcctggtaccaacagaaacctggccaggctcccaggctcctcatctatgatgcatcttacagggccactggcatcccagccaggttcagtggcagtgggtctgggacagacttcactctcaccatcagcagcctagagcctgaagattttgcagtttattactgtcagcagcgtagcaactccctcacgttcggcggagggaccaaggtggagatcaaacgaactgtggctgcaccatctgtcttcatcttccgcc

SEQ ID NO: 557657 - DNA, 454 bp, Homo sapiens; identical to SEQ ID NO: 536347
  misc_feature: HIJSMM301BY2QI.19.86.H09.1.454.light.4.raw

SEQ ID NO: 557658 - DNA, 514 bp, Homo sapiens
  misc_feature: HIJSMM301COTDK.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctactgactcagccccactctgtgtcggagtctccggggaagacggtaaccatctcctgcacccgcagcagtggcacctttgccggctattatgtgcagtggttccggcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtgttcggcggagggaccaagctggccgtcctaggtcagcccaaggctgccccctcggtcactctgttcccaccctcctcgagtagtaca

SEQ ID NO: 557659 - DNA, 497 bp, Homo sapiens
  misc_feature: HIJSMM301DL5Y5.40.37.D04.1.454.light.4.raw
tctagcgactcacgaccggtgctcgatttagtagcatactgttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctgtttactactgcagctcatatgcaggcagcaataatttggtggttcggcggggggaccaagctgaccgtcctaggtcagcccaaggctccg

SEQ ID NO: 557660 - DNA, 526 bp, Homo sapiens
  misc_feature: HIJSMM301C9PWF.27.23.C01.1.454.light.4.raw
  modified_base (412)..(412): a, c, t, g, unknown or other
agcgtcgtctcacgaccggtgctcgatttagtacacgtgattagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattnttaattgtagttcatatacaaccagtgtacattttggggtgttcggcggagggaccaggctgaccgtcctaggtcagcccaaggctgccccctcggtcactctgttcccgccct

SEQ ID NO: 557661 - DNA, 518 bp, Homo sapiens; identical to SEQ ID NO: 543797
  misc_feature: HIJSMM301C9O7Z.19.80.H03.1.454.light.4.raw

SEQ ID NO: 557662 - DNA, 487 bp, Homo sapiens
  misc_feature: HIJSMM301CCWFD.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccgggtgggggctgaggatgttggcatttattactgcatgcaggctatacaccttcctgccacttttggccaggggccaagctggagatcaggcgaacg

SEQ ID NO: 557663 - DNA, 493 bp, Homo sapiens; identical to SEQ ID NO: 535047
  misc_feature: HIJSMM301A7S7W.16.53.E09.1.454.light.4.raw

SEQ ID NO: 557664 - DNA, 487 bp, Homo sapiens; identical to SEQ ID NO: 535069
  misc_feature: HIJSMM301CX02H.26.23.C01.1.454.light.4.raw

SEQ ID NO: 557665 - DNA, 514 bp, Homo sapiens
  misc_feature: HIJSMM301BO6KR.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcgtccgaaggaccgaacggtaggaaagtacaagacgaacctagtggcgtgcaccactctgtcttctactcttcccgt

SEQ ID NO: 557666 - DNA, 488 bp, Homo sapiens; identical to SEQ ID NO: 538811
  misc_feature: HIJSMM301B8EVJ.40.83.H06.1.454.light.4.raw

SEQ ID NO: 557667 - DNA, 483 bp, Homo sapiens
  misc_feature: HIJSMM301BYO2Q.7.76.G10.1.454.light.4.raw
cgtgtctctacacgaccggtgctcgatttagtcactcatacagggggcaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagcccctaaactcctgatctctgctgcatccagtttacaaagtggggtcccatcgcggttcagcggcagtggatatgggacatatttcactctcgccatcagcagcctgcagcctgaagattttgcaacttactattgtcaacaggctaacagtttcccgctcaccttcggcgggggaccgaaggtggagagtcaaacgaactgtggctgcaccact

SEQ ID NO: 557668 - DNA, 480 bp, Homo sapiens
  misc_feature: HIJSMM301EL46A.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactaccctctcactttcggcggggaccgaaggtggagatcaacgaactgtggctgcacca

SEQ ID NO: 557669 - DNA, 501 bp, Homo sapiens; identical to SEQ ID NO: 550139
  misc_feature: HIJSMM301B5EAR.15.56.F01.1.454.light.4.raw

SEQ ID NO: 557670 - DNA, 483 bp, Homo sapiens
  misc_feature: HIJSMM301A3RRT.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattatgcatgcaagctctacaagtcccgctcactttcggcggagggaccaaggtggagatcaaacgaa

SEQ ID NO: 557671 - DNA, 513 bp, Homo sapiens; identical to SEQ ID NO: 552442
  misc_feature: HIJSMM301BT2KH.47.85.H08.1.454.light.4.raw

SEQ ID NO: 557672 - DNA, 507 bp, Homo sapiens; identical to SEQ ID NO: 535316
  misc_feature: HIJSMM301BC7YB.18.37.D04.1.454.light.4.raw

SEQ ID NO: 557673 - DNA, 504 bp, Homo sapiens
  misc_feature: HIJSMM301DA9TL.48.70.G04.1.454.light.4.raw
agtatacatacacgaccggtgctcgatttagtgtagtgtgaagggaaagggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaagctgctcatttactcggcatccacccggaaatccggagttcctgaccgattccgtggcagcgggtctgggacagattttactctcaccatcagtagcctgcaggctgaagatgtggcagtttattactgtcaacaatattattatactccgccgacgttcggccgggggaccaacgtggaaatcaaacgaactgtggctgcaccatctgt

SEQ ID NO: 557674 - DNA, 505 bp, Homo sapiens; identical to SEQ ID NO: 546412
  misc_feature: HIJSMM301AX1OU.22.21.B10.1.454.light.4.raw

SEQ ID NO: 557675 - DNA, 505 bp, Homo sapiens; identical to SEQ ID NO: 535987
  misc_feature: HIJSMM301DTKD9.18.37.D04.1.454.light.4.raw

SEQ ID NO: 557676 - DNA, 444 bp, Homo sapiens; identical to SEQ ID NO: 535192
  misc_feature: HIJSMM301CIDZO.5.9.A09.1.454.light.4.raw

SEQ ID NO: 557677 - DNA, 441 bp, Homo sapiens; identical to SEQ ID NO: 550529
  misc_feature: HIJSMM301CCY5Y.41.9.A09.1.454.light.4.raw

SEQ ID NO: 557678 - DNA, 485 bp, Homo sapiens
  misc_feature: HIJSMM301EDXMI.48.35.D02.1.454.light.4.raw
agtatacatacacgaccggtgctcgatttagcacacgatagttgggtttgggggctgtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaagg

SEQ ID NO: 557679 - DNA, 505 bp, Homo sapiens
  misc_feature: HIJSMM301A7G14.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggtagtttattactgtcaacagtttttctcgggcgttcgaccaagggaccaaggtaggaaatcaaaacgaactagtggctgcaccatctgtcttcatcttcccg

SEQ ID NO: 557680 - DNA, 497 bp, Homo sapiens; identical to SEQ ID NO: 536371
  misc_feature: HIJSMM301EBY68.16.78.H01.1.454.light.4.raw

SEQ ID NO: 557681 - DNA, 468 bp, Homo sapiens
  misc_feature: HIJSMM301C3J1L.3.38.D05.1.454.light.4.raw
agacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtgggtcccatcaaggttcagtggcagtggatctgggacagatttcactctcaccatcaacagtctgcaacctgaagattttgcaacttactactgtcaacagagtttcactaccctatcactttcggcgggggaccaggtggagatcaacgaa

SEQ ID NO: 557682 - DNA, 474 bp, Homo sapiens
  misc_feature: HIJSMM301D11JP.51.75.G09.1.454.light.4.raw
cgatcgtatacacgaccggtgctcgatttagtatagacatcagggggcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcaggtaatgatgtacactggtaccagcagcttccaggaacagtccccaaactcctcatttatgctaacaccaatcggccctcaggggtccctgcccgattctctggctccaggtctggcacctcagcctccctggccatcactgggctccgggctgaggatgaggctgattattactgccagtcccatgacagcagcctgagtgtgctgttcggcgagggaccaagctgaccgt

SEQ ID NO: 557683 - DNA, 490 bp, Homo sapiens; identical to SEQ ID NO: 534991
  misc_feature: HIJSMM301CL91D.48.75.G09.1.454.light.4.raw

SEQ ID NO: 557684 - DNA, 484 bp, Homo sapiens; identical to SEQ ID NO: 535240
  misc_feature: HIJSMM301BTBI8.47.60.F05.1.454.light.4.raw

SEQ ID NO: 557685 - DNA, 482 bp, Homo sapiens; identical to SEQ ID NO: 542083
  misc_feature: HIJSMM301DKXSS.5.39.D06.1.454.light.4.raw

SEQ ID NO: 557686 - DNA, 484 bp, Homo sapiens; identical to SEQ ID NO: 536162
  misc_feature: HIJSMM301BY2P2.13.59.F04.1.454.light.4.raw

SEQ ID NO: 557687 - DNA, 477 bp, Homo sapiens; identical to SEQ ID NO: 545166
  misc_feature: HIJSMM301B0VF5.5.28.C06.1.454.light.4.raw

SEQ ID NO: 557688 - DNA, 484 bp, Homo sapiens; identical to SEQ ID NO: 538396
  misc_feature: HIJSMM301BIRSA.15.1.A01.1.454.light.4.raw

SEQ ID NO: 557689 - DNA, 480 bp, Homo sapiens
  misc_feature: HIJSMM301AEASQ.12.10.A10.1.454.light.4.raw
atacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggccagtcaggacattagcaattatttaggctggtatcagcagaagccagggaaagcccctaacgtcctgatctatggtgcatccactttgcatagtggggtcccatcaaggttcagcggcagtggatctgggacagaattcactctcacaatcaccagcctgcagcctgaagattttgcaacttattactgtcaacaggtttatatttaccctcgtattttcggccctgggaccacagtagatatcaaacgaaactgtggctgcacc

SEQ ID NO: 557690 - DNA, 493 bp, Homo sapiens; identical to SEQ ID NO: 536289
  misc_feature: HIJSMM301BL7J1.14.5.A05.1.454.light.4.raw

SEQ ID NO: 557691 - DNA, 476 bp, Homo sapiens; identical to SEQ ID NO: 541471
  misc_feature: HIJSMM301D4KOW.13.4.A04.1.454.light.4.raw

SEQ ID NO: 557692 - DNA, 487 bp, Homo sapiens
  misc_feature: HIJSMM301DSX4X.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacaggctgcccccaaccttcggccaggggacacgactggagaattaaacgaactgtggctgcaccatctgtt

SEQ ID NO: 557693 - DNA, 464 bp, Homo sapiens; identical to SEQ ID NO: 537214
  misc_feature: HIJSMM301EPYGI.18.59.F04.1.454.light.4.raw

SEQ ID NO: 557694 - DNA, 489 bp, Homo sapiens; identical to SEQ ID NO: 536013
  misc_feature: HIJSMM301AE1B4.26.23.C01.1.454.light.4.raw

SEQ ID NO: 557695 - DNA, 503 bp, Homo sapiens; identical to SEQ ID NO: 541454
  misc_feature: HIJSMM301EBJQN.9.12.B01.1.454.light.4.raw

SEQ ID NO: 557696 - DNA, 502 bp, Homo sapiens
  misc_feature: HIJSMM301DFAFK.22.15.B04.1.454.light.4.raw
acatacgcgtcacgaccggtgctcgatttagacagtatatatccgcgggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacaacacccaggcaaagcccccaaactcatgatttatgaggtcactaagcggccctcaggggtccctgatcgcttctctggctccaagtctggcaacacggcctccctgaccgtctctgggctccaggctgaggatgaggctgattattactgcagctcatatggaggcagcgacaatttggtgttcggcggagggaccaagctgaccgtcctaggtcagcccaaggctgccccctcggtca

SEQ ID NO: 557697 - DNA, 488 bp, Homo sapiens; identical to SEQ ID NO: 537124
  misc_feature: HIJSMM301AERMK.11.25.C03.1.454.light.4.raw

SEQ ID NO: 557698 - DNA, 503 bp, Homo sapiens
  misc_feature: HIJSMM301CIB09.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccaaactgaccgtcctaggtcagcccaaggctgccccctcc

SEQ ID NO: 557699 - DNA, 490 bp, Homo sapiens
  misc_feature: HIJSMM301CNMVA.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttgggtttattactgcatgcaagctctacaaactccttacacttttggccaggggaccaagctggagatcaaacgaactgt

SEQ ID NO: 557700 - DNA, 463 bp, Homo sapiens; identical to SEQ ID NO: 535062
  misc_feature: HIJSMM301EMJSV.11.73.G07.1.454.light.4.raw

SEQ ID NO: 557701 - DNA, 510 bp, Homo sapiens
  misc_feature: HIJSMM301BFRKG.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaaggtggaaagtacaaacgaaactacgtggctgcaccatctgttcttctatcttccccg

SEQ ID NO: 557702 - DNA, 489 bp, Homo sapiens; identical to SEQ ID NO: 535386
  misc_feature: HIJSMM301DV5AA.12.51.E07.1.454.light.4.raw

SEQ ID NO: 557703 - DNA, 508 bp, Homo sapiens; identical to SEQ ID NO: 537871
  misc_feature: HIJSMM301AIWJR.8.33.C11.1.454.light.4.raw

SEQ ID NO: 557704 - DNA, 493 bp, Homo sapiens; identical to SEQ ID NO: 535084
  misc_feature: HIJSMM301A8I7L.47.64.F09.1.454.light.4.raw

SEQ ID NO: 557705 - DNA, 504 bp, Homo sapiens
  misc_feature: HIJSMM301DOY2I.8.28.C06.1.454.light.4.raw
ctcgcgtgtccacgaccggtgctcgatttagagctcacgtattgggtttgggggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggccggagggaccaaggtggacctcaaacgaactgtggctgcaccatctgtcttcatcttcccgcat

SEQ ID NO: 557706 - DNA, 494 bp, Homo sapiens; identical to SEQ ID NO: 549057
  misc_feature: HIJSMM301DITJU.10.33.C11.1.454.light.4.raw

SEQ ID NO: 557707 - DNA, 487 bp, Homo sapiens
  misc_feature: HIJSMM301BNTP8.21.4.A04.1.454.light.4.raw
tcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagagccaccctctcctgcagctccagccagaatatccagagctactacatagcctggtaccagcagaagcctggccaggctcccaggttcctcatctatgctgggtcccacagggccactggcatcccagacaggttccagtggcagtgggtctgggacagacttcactctcatcattagcagactggagcctgaagatttcgcagtgtattactgtcagcagtatggaagttcacctctgtcgttcggccaagggaccaaggtagaaatgaaacgaactgtggctgcaccat

SEQ ID NO: 557708 - DNA, 496 bp, Homo sapiens; identical to SEQ ID NO: 556037
  misc_feature: HIJSMM301A77VC.41.38.D05.1.454.light.4.raw

SEQ ID NO: 557709 - DNA, 514 bp, Homo sapiens; identical to SEQ ID NO: 541502
  misc_feature: HIJSMM301B025K.15.34.D01.1.454.light.4.raw

SEQ ID NO: 557710 - DNA, 513 bp, Homo sapiens; identical to SEQ ID NO: 535719
  misc_feature: HIJSMM301D37K6.17.33.C11.1.454.light.4.raw

SEQ ID NO: 557711 - DNA, 492 bp, Homo sapiens; identical to SEQ ID NO: 534967
  misc_feature: HIJSMM301A3P4A.47.64.F09.1.454.light.4.raw

SEQ ID NO: 557712 - DNA, 501 bp, Homo sapiens; identical to SEQ ID NO: 535746
  misc_feature: HIJSMM301BSW1T.18.11.A11.1.454.light.4.raw

SEQ ID NO: 557713 - DNA, 443 bp, Homo sapiens
  misc_feature: HIJSMM301B323V.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgttcccgccctcctcgaacgcgag

SEQ ID NO: 557714 - DNA, 489 bp, Homo sapiens
  misc_feature: HIJSMM301DR8JG.52.85.H08.1.454.light.4.raw
cgcagtacgacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgacctgactcagccaccctcagtgtccgtgtctccaggacagacagccaccatcacctgctctggagataaattggggggaaaatatgcttgctggtatcaacagcggccaggccagtcccctgtactggtcatctatctgaatagtaggcggccctctgggatccctgaccgattctctggctcccactctgggaacacagccactctgaccatcagcgggacccaggctttggatgaggctgactattactgtcaggcgtgggacaccatcactggagtaatattcggcggaggaccaggctgaccgtcctaggtcagcccaaggctgccccctcggt

SEQ ID NO: 557715 - DNA, 441 bp, Homo sapiens; identical to SEQ ID NO: 534971
  misc_feature: HIJSMM301D40KI.11.3.A03.1.454.light.4.raw

SEQ ID NO: 557716 - DNA, 466 bp, Homo sapiens
  misc_feature: HIJSMM301BM9N1.3.20.B09.1.454.light.4.raw
agacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcgtctatttaaattggtatcagcacaaaccagggaaagcccctaagctcctgatctatgctgaatccactttgcaaagtggggtcccatcaaggttcagtggcagtggatctgggacagatttcactctaaccatcagcggtctgcaacctgaagattttgcaactcactactgtcaacagagtgacagcacgcctcacacttcggcggagggaccgaaggtggagatcaaacgaa

SEQ ID NO: 557717 - DNA, 492 bp, Homo sapiens; identical to SEQ ID NO: 537666
  misc_feature: HIJSMM301DG2UD.43.33.C11.1.454.light.4.raw

SEQ ID NO: 557718 - DNA, 505 bp, Homo sapiens; identical to SEQ ID NO: 535987
  misc_feature: HIJSMM301AWL31.18.37.D04.1.454.light.4.raw

SEQ ID NO: 557719 - DNA, 473 bp, Homo sapiens; identical to SEQ ID NO: 538875
  misc_feature: HIJSMM301B1LNJ.4.75.G09.1.454.light.4.raw

SEQ ID NO: 557720 - DNA, 484 bp, Homo sapiens; identical to SEQ ID NO: 544622
  misc_feature: HIJSMM301AJAU5.15.28.C06.1.454.light.4.raw

SEQ ID NO: 557721 - DNA, 442 bp, Homo sapiens
  misc_feature: HIJSMM301DB4AQ.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctcgccccctcggtcactctgttcccaccctcctcgtatctctcg

SEQ ID NO: 557722 - DNA, 486 bp, Homo sapiens; identical to SEQ ID NO: 535043
  misc_feature: HIJSMM301BZSYQ.46.35.D02.1.454.light.4.raw

SEQ ID NO: 557723 - DNA, 485 bp, Homo sapiens; identical to SEQ ID NO: 543441
  misc_feature: HIJSMM301EO8QT.26.55.E11.1.454.light.4.raw

SEQ ID NO: 557724 - DNA, 502 bp, Homo sapiens
  misc_feature: HIJSMM301BAYT0.40.28.C06.1.454.light.4.raw
tctagcgactcacgaccggtgctcgatttagagctcacgtattgggtttggggagagaagagcttctcagttaggacccagagggaaccatggaaaccccagcgcagcttctcttcctcctgctactctggctcccagatgccaccggagaaattgtgttgacgcagtctccaggtaccctgtctttgtctccaggggaaagagccaccctctcctgcagggccagtcagagtattaggaacactgtccaaggctggtatcagcataaacctggccaggctcccaggctcctcatctatgagacgtccaggagggccagtggcatcccagacaggttcagtagcagtgggtctgggaccgacttcactctaaccatcagtagactggaacctgaagactctgcagtgtattactgtcaacactttgaaggcccacttatcacattcggcggagggaccaaggtggagatcaagcgaactgtggctgcaccatctgtcttcat

SEQ ID NO: 557725 - DNA, 505 bp, Homo sapiens
  misc_feature: HIJSMM301ETWW9.19.85.H08.1.454.light.4.raw
tactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctccccaaactcctgtcgtacaggaatgacaaccggccctcaaacatttcagagagattttctacctccaggacacaaaatacagcctctctgaccattactggtctccagccctgacgacgaggctgactactactgctcagcctgggacaccagcctcgctgcttggcttttcggcggagggaccaagctgaccgtcctgggtcagcccaaggctgccccctcggt

SEQ ID NO: 557726 - DNA, 506 bp, Homo sapiens
  misc_feature: HIJSMM301AEM5B.47.83.H06.1.454.light.4.raw
agctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatactcccccagctggtaccagcagaccccgggccagactccacgcacgctcatctacaacacagacactcgctcttctggggtccctgatcgcttctctggttccatccttgggaacaaagctgccctcaccatcgcgggggcccaggcagatgatgagtgtgattattactgtgtgctctatatgggcagtggcgtttgggtgttcggcggagggaccaagctgaccgtcg

SEQ ID NO: 557727 - DNA, 494 bp, Homo sapiens; identical to SEQ ID NO: 534992
  misc_feature: HIJSMM301CH8HI.9.1.A01.1.454.light.4.raw

SEQ ID NO: 557728 - DNA, 502 bp, Homo sapiens
  misc_feature: HIJSMM301BX3X3.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggagctgaggatggttgggtttattactgcatgacaactacacacggccgctctacgtttcggcgggaggaccgaaggtggagatacaaacgaactgtggctgcacc

SEQ ID NO: 557729 - DNA, 495 bp, Homo sapiens; identical to SEQ ID NO: 538942
  misc_feature: HIJSMM301BJKX5.43.61.F06.1.454.light.4.raw

SEQ ID NO: 557730 - DNA, 487 bp, Homo sapiens
  misc_feature: HIJSMM301A0CMY.41.55.E11.1.454.light.4.raw
tctatactatcacgaccggtgctcgatttagcactcgcacgttgggtttggggtccaaacagagcttcagcaagcatagtgggaatctgcaccatgccctgggctctgctcctcctgaccctcctcactcactctgcagtgtcagtggtccaggcaggactgactcagccaccctcggtgtccaagggcttgagacagaccgccacactcacctgcactgggaacagctacaatgttggcaacgaaggagcagcttggctgcagcagtaccagggccaccctcccaaattgctatcatacaggaagaacaaccgcccctcggggatctccgagagattctctgcatcaacgtcaggaaacatagcctccctgaccattactggactccagcctgaggacgaggctgactattactgctcagcatgggacagcagcctcaatgtttgggtgttcggcggagggaccaagctgaccgtcctaggtcacg

SEQ ID NO: 557731 - DNA, 494 bp, Homo sapiens; identical to SEQ ID NO: 540110
  misc_feature: HIJSMM301B26Y4.51.71.G05.1.454.light.4.raw

SEQ ID NO: 557732 - DNA, 468 bp, Homo sapiens
  misc_feature: HIJSMM301AJGI6.49.61.F06.1.454.light.4.raw
agtcgagagacacgaccggtgctcgatttagctacgctctaagggaaagggggagtcagtcccaaccaggacacagcatggacatgagggtccctgctcagctcctggggctcctgctgctctggctctcaggtgccagatgtgtcatccagatgacccagtctccttcctccctgtctgcatctataggagacagaatcaccatcacttgccgggcgagtcgagacattagcatgtatctgaattggtatcagcaaaaaccagggacagcccctaaactcctgatcctcgatgcatccactttggagacaggggtcccatcaaggttcagtggaagtggctctgggacagattttactttcaccatcagcaggctgcagcctgaagatattgcaacatattactgtcaacagtatgatcgtctccgctcactttcggcggggggaccgaaggtggagatcaagcgaa

SEQ ID NO: 557733 - DNA, 488 bp, Homo sapiens; identical to SEQ ID NO: 535861
  misc_feature: HIJSMM301EFH9W.14.55.E11.1.454.light.4.raw

SEQ ID NO: 557734 - DNA, 484 bp, Homo sapiens; identical to SEQ ID NO: 539003
  misc_feature: HIJSMM301BVZWJ.10.1.A01.1.454.light.4.raw

SEQ ID NO: 557735 - DNA, 497 bp, Homo sapiens
  misc_feature: HIJSMM301DCWC7.22.27.C05.1.454.light.4.raw
acatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttattactgtcagcaatattatattcctcctcagacgttcggccaagggaccaaggtggaaatacaaacgaactgtggctgcacc

SEQ ID NO: 557736 - DNA, 494 bp, Homo sapiens; identical to SEQ ID NO: 534992
  misc_feature: HIJSMM301AY6DO.9.1.A01.1.454.light.4.raw

SEQ ID NO: 557737 - DNA, 476 bp, Homo sapiens
  misc_feature: HIJSMM301AOUOV.51.9.A09.1.454.light.4.raw
cgatcgtatacacgaccggtgctcgatttagcgagacgcgcagagagaaggggctgggcctcaggaagcagcatcggaggtgcctcagccatggcatggatccctctcttcctcggcgtccttgcttactgcacaggatccgtggcctcctatgaactgactcagccaccctcagtgtccgtgtccccaggacagacagcgaccatcacctgttctggagacagattgactgataaatatgctggctggtatcggcagaagccaggccagtcccctgtgttggtcatctatcaggataccaagcggccctcagggatccctgagcgattctctggctccaactctgggaacacagccactctgaccatcagcgggactcaggctatcgatgaggctgactattactgtcaggcgtgggacagccgcactggggtattcggcggaggggaccaagctgaccgtcctgagtcagcccg

SEQ ID NO: 557738 - DNA, 496 bp, Homo sapiens; identical to SEQ ID NO: 535556
  misc_feature: HIJSMM301A9LZC.26.80.H03.1.454.light.4.raw

SEQ ID NO: 557739 - DNA, 488 bp, Homo sapiens; identical to SEQ ID NO: 546043
  misc_feature: HIJSMM301DWPD8.13.87.H10.1.454.light.4.raw

SEQ ID NO: 557740 - DNA, 490 bp, Homo sapiens; identical to SEQ ID NO: 535234
  misc_feature: HIJSMM301EGVHL.17.21.B10.1.454.light.4.raw

SEQ ID NO: 557741 - DNA, 518 bp, Homo sapiens; identical to SEQ ID NO: 535407
  misc_feature: HIJSMM301CQQAL.22.30.C08.1.454.light.4.raw

SEQ ID NO: 557742 - DNA, 515 bp, Homo sapiens
  misc_feature: HIJSMM301CDA8S.48.14.B03.1.454.light.4.raw
agtatacatacacgaccggtgctcgatttagtgtgagtagttccgcggggatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaagtaaaaatggaaacatttacttacattggtttcaacagaggccaggccagtctccaaggcgcctgatttatgacgtttttaaacgggagtctggggtcccagacagattcagcggcagtgggtcagacactgacttcacactgagaatcagcagggttgaggctgaggatgttggcacttattactgcatgcaaggctcacactggcctccgtggacgttggccaagggacccgggtggaaataaaacgaaactgtggctgcaccatctgtcttcatcttccccg

SEQ ID NO: 557743 - DNA, 500 bp, Homo sapiens
  misc_feature: HIJSMM301DIZ32.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctggtcact

SEQ ID NO: 557744 - DNA, 486 bp, Homo sapiens; identical to SEQ ID NO: 535523
  misc_feature: HIJSMM301EQ2FT.22.73.G07.1.454.light.4.raw

SEQ ID NO: 557745 - DNA, 501 bp, Homo sapiens
  misc_feature: HIJSMM301D2UIH.48.67.G01.1.454.light.4.raw
agtatacatacacgaccggtgctcgatttagagtatacatattgggttggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggaggaccaaggtggacatcaaacgaactgtggctgcaccatctgtcttcatcttccccg

SEQ ID NO: 557746 - DNA, 473 bp, Homo sapiens
  misc_feature: HIJSMM301D4M98.4.23.C01.1.454.light.4.raw
agcactgtagcacgaccggtgctcgatttagtacacgtgattagggattggggagtcccaaccaggacacagcatggacatgagggtccctgctcagctcctggggctcctgctgctctggctctcaggtgccagatgtgacatccagatgacccagtctccatcctccctgtctgcttctgtaggagacagagtcaccatcacttgccaggcgagtcaggacattaacaactatttaatttggtatcagcagaaaccaggccatgcccctaggctcctgatctacgatgcatcccatttggaaacaggggtcccatcaaggttcagtggaggtggatatgggacagattttactttcaccatcagcagcctgcagcctgaagatactgcaacatattactgtcaacagtatgataatctgccgctcactttcggcggagggaccgaaggtaggaggatcaagagaactgtgg

SEQ ID NO: 557747 - DNA, 483 bp, Homo sapiens
  misc_feature: HIJSMM301D0Z69.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcaacacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacacaccctgcgtggttttggctgttcggcggcgggaccaag

SEQ ID NO: 557748 - DNA, 494 bp, Homo sapiens
  misc_feature: HIJSMM301B3156.13.5.A05.1.454.light.4.raw
tcacgtactacacgaccggtgctcgatttagatagatagacaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagcctacatcacctgctctggagatgtattgactaacgagtatggttcctggtatcagcagaaggcaggccagccccctgtcctactcatctttcaaataccaggcggccctctggggtccctgagcgattctccggctccgcctctgggaacacagtcactctgaccatcagcgggacccagcctattgatgaggctgtctacttctgtcaggcgtgggacaacagcgtgctgttcggcggagggaccagtctgaccgtcttaggtcagcccaaggctgccccctcggtcactctgttcccta

SEQ ID NO: 557749 - DNA, 494 bp, Homo sapiens; identical to SEQ ID NO: 540664
  misc_feature: HIJSMM301CUMF4.47.64.F09.1.454.light.4.raw

SEQ ID NO: 557750 - DNA, 503 bp, Homo sapiens
  misc_feature: HIJSMM301CV2HQ.8.71.G05.1.454.light.4.raw
ctcgcgtgtccacgaccggtgctcgatttagtgtcgtcgcaagagagagggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccagggaaagcccctaaatacctggtctatactgcatccactttgcaaagtggggtcccatcaaggttcagtggcagtggatttgggacagttttcactctcacaatcagcagtctcgaacctgaagattttgcaacttactactgtcaacagacttacaatataccgaggacgttcggtcaagggaccaaggtggagatcaaacgaactgtggctgcaccatctgtcttcatcttccgccat

SEQ ID NO: 557751 - DNA, 494 bp, Homo sapiens; identical to SEQ ID NO: 535478
  misc_feature: HIJSMM301BAWFJ.10.79.H02.1.454.light.4.raw

SEQ ID NO: 557752 - DNA, 484 bp, Homo sapiens
  misc_feature: HIJSMM301BAOY8.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatctccccacttcgcctcggaccaagtaggatatcaaacgaactgtggctcgcaccatctgtt

SEQ ID NO: 557753 - DNA, 492 bp, Homo sapiens; identical to SEQ ID NO: 548647
  misc_feature: HIJSMM301D34S0.16.53.E09.1.454.light.4.raw

SEQ ID NO: 557754 - DNA, 521 bp, Homo sapiens; identical to SEQ ID NO: 557222
  misc_feature: HIJSMM301BE0IH.41.19.B08.1.454.light.4.raw

SEQ ID NO: 557755 - DNA, 476 bp, Homo sapiens; identical to SEQ ID NO: 538026
  misc_feature: HIJSMM301B4RNY.13.76.G10.1.454.light.4.raw

SEQ ID NO: 557756 - DNA, 487 bp, Homo sapiens; identical to SEQ ID NO: 549731
  misc_feature: HIJSMM301EFDGQ.8.12.B01.1.454.light.4.raw

SEQ ID NO: 557757 - DNA, 488 bp, Homo sapiens; identical to SEQ ID NO: 535990
  misc_feature: HIJSMM301BMFYK.11.28.C06.1.454.light.4.raw

SEQ ID NO: 557758 - DNA, 489 bp, Homo sapiens; identical to SEQ ID NO: 544329
  misc_feature: HIJSMM301AOC9B.11.28.C06.1.454.light.4.raw

SEQ ID NO: 557759 - DNA, 517 bp, Homo sapiens; identical to SEQ ID NO: 552423
  misc_feature: HIJSMM301D8MB1.22.30.C08.1.454.light.4.raw

SEQ ID NO: 557760 - DNA, 495 bp, Homo sapiens; identical to SEQ ID NO: 535821
  misc_feature: HIJSMM301DLMJ1.3.31.C09.1.454.light.4.raw

SEQ ID NO: 557761 - DNA, 490 bp, Homo sapiens; identical to SEQ ID NO: 535234
  misc_feature: HIJSMM301B4SCW.17.21.B10.1.454.light.4.raw

SEQ ID NO: 557762 - DNA, 520 bp, Homo sapiens; identical to SEQ ID NO: 537173
  misc_feature: HIJSMM301D1UD9.27.23.C01.1.454.light.4.raw

SEQ ID NO: 557763 - DNA, 494 bp, Homo sapiens; identical to SEQ ID NO: 536463
  misc_feature: HIJSMM301AXXYO.22.57.F02.1.454.light.4.raw

SEQ ID NO: 557764 - DNA, 495 bp, Homo sapiens
  misc_feature: HIJSMM301DLJ0Q.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggcgggggaccaaggtggagttcaaacgaaactgtggctgcaccatctgtcttcatt

SEQ ID NO: 557765 - DNA, 496 bp, Homo sapiens
  misc_feature: HIJSMM301CECZ3.52.33.C11.1.454.light.4.raw
cgcagtacgacacgaccggtgctcgatttagagtgagctcgttgggtttgggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctcctcctcagggacaacagtcacgttgatcatcagtggagtccgggcagaggacgaggctgactattactgtcaatcaacagacagtagtggtacttatgtgcagttcggcggagggaccaagctgaccgtcctaggtcagcccaaggctgccccctggtcactctgttccccg

SEQ ID NO: 557766 - DNA, 496 bp, Homo sapiens; identical to SEQ ID NO: 536326
  misc_feature: HIJSMM301APOB2.16.12.B01.1.454.light.4.raw

SEQ ID NO: 557767 - DNA, 494 bp, Homo sapiens; identical to SEQ ID NO: 535629
  misc_feature: HIJSMM301ALKDS.4.27.C05.1.454.light.4.raw

SEQ ID NO: 557768 - DNA, 521 bp, Homo sapiens
  misc_feature: HIJSMM301CJ4LF.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggcctgccccctcggtccacttcgttcctccctccctcctacg

SEQ ID NO: 557769 - DNA, 524 bp, Homo sapiens; identical to SEQ ID NO: 544145
  misc_feature: HIJSMM301AESVK.49.9.A09.1.454.light.4.raw

SEQ ID NO: 557770 - DNA, 503 bp, Homo sapiens
  misc_feature: HIJSMM301EHN0E.18.78.H01.1.454.light.4.raw
tacgagtatgcacgaccggtgctcgatttagtgtgagtagtttgggtttgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttaggaactgggaccaaggtcacgtcctaggtcagcccaaggccaacccactgtca

SEQ ID NO: 557771 - DNA, 511 bp, Homo sapiens
  misc_feature: HIJSMM301CTB87.43.5.A05.1.454.light.4.raw
tgtgagtagtcacgaccggtgctcgatttagatagatagacaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggaactgtcaccagtggtcattatccctactggttccagcagaagcctggccaggccccccggacactgatttatgatacaagcaacaaactttcctggacacctgcccgattctcaggctccctccttgggggcaaagctgccctgaccctttcgggtgcgcagcctgaggatgaggctgactattactgcttgctcgcctatgatgctgctcgggttttcggcggaggaccaagttgaccgtcctaggtcagcccaaggctgccccctcggtcactctgttcccgccctcctcta

SEQ ID NO: 557772 - DNA, 492 bp, Homo sapiens; identical to SEQ ID NO: 535426
  misc_feature: HIJSMM301CGCPP.47.78.H01.1.454.light.4.raw

SEQ ID NO: 557773 - DNA, 502 bp, Homo sapiens
  misc_feature: HIJSMM301B4OV4.13.55.E11.1.454.light.4.raw
tcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctccctgtctgcatctgtaggagacagagtcaccatcacttgccgggcaagtcagagcattaccaactatttgaattggtatcaacaaaaaccagggagagcccctcacctccttatctatggtgcatccaccttacaaagtggggtcccatcaaggttcagtggcactggatctgggacagatttcactctcaccatcagcagtctgcaacctgaagattttgcaacttattactgtcaacagagtttcagtacgcggacgttcggccaaggaccgaaggtggaaatacaaacgaactagtggcgtgcaccatctgtcttcatcttccccg

SEQ ID NO: 557774 - DNA, 502 bp, Homo sapiens
  misc_feature: HIJSMM301DN61M.21.22.B11.1.454.light.4.raw
  modified_base (460)..(460): a, c, t, g, unknown or other
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggnttcgggcggagggaccaaactgaccgtcctaggtcagcccaa

SEQ ID NO: 557775 - DNA, 518 bp, Homo sapiens; identical to SEQ ID NO: 539372
  misc_feature: HIJSMM301AN36J.7.86.H09.1.454.light.4.raw

SEQ ID NO: 557776 - DNA, 473 bp, Homo sapiens
  misc_feature: HIJSMM301ADWWT.49.8.A08.1.454.light.4.raw
agtcgagagacacgaccggtgctcgatttagcatactctacagggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctgaattggtatcagcaaaaaccagggacagcccctaagctcctgatcctcgatgcatccactttggaaacaggggtcccatcaaggttcagtggaagtggctctgggacagattttactttcaccatcagcagactgcagcctgaagatattgcaacatattactgtcaacagtatgatagtctcccgctcacttcggtcggagggaccgaaggtaggaggatcaaacgaaactagtgg

SEQ ID NO: 557777 - DNA, 508 bp, Homo sapiens; identical to SEQ ID NO: 536388
  misc_feature: HIJSMM301DN2SI.11.57.F02.1.454.light.4.raw

SEQ ID NO: 557778 - DNA, 499 bp, Homo sapiens
  misc_feature: HIJSMM301DZT4S.10.43.D10.1.454.light.4.raw
catagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaagtggatatcaacgaactgtggctgcaccatctgtcttcat

SEQ ID NO: 557779 - DNA, 495 bp, Homo sapiens; identical to SEQ ID NO: 535007
  misc_feature: HIJSMM301AVKHL.22.5.A05.1.454.light.4.raw

SEQ ID NO: 557780 - DNA, 509 bp, Homo sapiens
  misc_feature: HIJSMM301BS57X.13.3.A03.1.454.light.4.raw
tcacgtactacacgaccggtgctcgatttagagagcgtcacagggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaacacccaggcaaagcccccaaactcattatttacggggtcaataagcggccctcagggctttctgatcgcttctctggctccaagtctggcaacacggcctccctgacaatctctggactccaggccgaggacgaggctgatttttactgttgttcatatgcaggaaggagtgattatgtctttggaagtgggaccaaggtcaccgtccttggtcagcccaaggccaaccccactgtcactctgttccca

SEQ ID NO: 557781 - DNA, 447 bp, Homo sapiens; identical to SEQ ID NO: 535882
  misc_feature: HIJSMM301EOSH3.18.9.A09.1.454.light.4.raw
  modified_base (429)..(429): a, c, t, g, unknown or other

SEQ ID NO: 557782 - DNA, 484 bp, Homo sapiens; identical to SEQ ID NO: 535240
  misc_feature: HIJSMM301AH7DL.47.60.F05.1.454.light.4.raw

SEQ ID NO: 557783 - DNA, 480 bp, Homo sapiens; identical to SEQ ID NO: 554620
  misc_feature: HIJSMM301CHHHS.4.29.C07.1.454.light.4.raw

SEQ ID NO: 557784 - DNA, 501 bp, Homo sapiens
  misc_feature: HIJSMM301C76XR.14.57.F02.1.454.light.4.raw
cgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgcagttattactgtcagcagcgggcaattggccgctcactttcggcgggggaccgaaggtggagttcaacgaactgtggctgcaccatctgtcttcatcttcccgccta

SEQ ID NO: 557785 - DNA, 488 bp, Homo sapiens; identical to SEQ ID NO: 540342
  misc_feature: HIJSMM301BMBK3.43.33.C11.1.454.light.4.raw

SEQ ID NO: 557786 - DNA, 487 bp, Homo sapiens
  misc_feature: HIJSMM301CASEU.5.70.G04.1.454.light.4.raw
atcagacacgcacgaccggtgctcgatttagtgtagtgtgaagggaaagggggagtcagacccagtcaggacacagcatggacatgagggtccccgctcagctcctggggctcctgctgctctggttcccaggttccagttgcgacatccagatgacccagtctccatcgtccgtgtctgcatctgtaggagacagagtcaccatcacttgtcaggcgagtcaggacattggtaattacttaacttggtatcagcagaaaccagggaaagtccccaaactcctgatctacgatgcatctaatttggaaataggggtctcatcaaggttcagtgggagtggatctgggacagaattcactttcaccatcagcagcctgcaacctgaagatattgcaacatattactgtcaacagtatgatagtctggccgccttcggcggagggaccaaggtggagatcgaacgaactgtggctgcaccatctgtctt

SEQ ID NO: 557787 - DNA, 478 bp, Homo sapiens
  misc_feature: HIJSMM301B35WN.10.74.G08.1.454.light.4.raw
catagtagtgcacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaggagccaccctctcctgcagggccagtcagagtattagcagcaacttagcctggtaccagcagaaacctggccagtctcccaggctcctcctctatgatgcatccaccagggccactggtatcccagccaggttcagtggcagtgggtctgggacagagttcactctcaccatcagcagcctgcagtctgaggatattgcagtttattactgtcagcagtatactaactggcctctgacgttcggccaagggaccagggtggaaatcaaacgactgtggctgcaccat

SEQ ID NO: 557788 - DNA, 486 bp, Homo sapiens
  misc_feature: HIJSMM301EW50Q.41.17.B06.1.454.light.4.raw
tctatactatcacgaccggtgctcgatttagtcgatagtgaaggggaggaactgctcagttaggacccagacggaaccatggaagccccagcgcagcttctcttcctcctgctactctggctcccagatatcacaggagagatagtgatgacgcagtctccagccaccctgtctctgtctccaggggaaagagcctccctctcctgcagggccagtcagaatattcgcggccacttagcctggtatcagcagaaacctggccaggctcccaggctcctcatctatgctgcatccaccagggccactggcatcccagacaggttcagtggcagtgggtctgggacagacttcactctctccatcagcagactggagcctgaagattttgcaatttattactgtcaccagtatggtagttcacctctaactttcggtcggagggaccgaaggtggaggatcaaacgaactgtggctgcaccatctgtt

SEQ ID NO: 557789 - DNA, 511 bp, Homo sapiens
  misc_feature: HIJSMM301CQH0D.53.71.G05.1.454.light.4.raw
cgcgtatacacacgaccggtgctcgatttagtgtcgtcgcaagagagagggggctgggcctaaggaagcagcactggtggtgcctcagccatggcctggaccgttctcctcctcggcctcctctctcactgcacaggctctgtgacctcctatctattgactcagccaccctcggtgtcagtggccccaggaaggacggccacgatgacctgtgcaggaaacaacattggaagtaaaagtgtgcactggtaccagcacaggccaggccaggcccctgcgctggtcgtctatgatgatagcgaccggccctcagggatccctgagcgattctctggctccaactctggggacacggccaccctgaccatcagcagggtcgaagccggagacgaggccgactattactgtcaggtgtgggattttaatagtgatcattgggtgttcggcggagggaccaagctgaccgtcctaggtcagcccaaggctgccccctcggtcactctgttccccg

SEQ ID NO: 557790 - DNA, 491 bp, Homo sapiens
  misc_feature: HIJSMM301ATVT2.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaacgggaccaaagtaggacgatcaagcgaactgtggctgcaccatct

SEQ ID NO: 557791 - DNA, 495 bp, Homo sapiens
  misc_feature: HIJSMM301DZTBZ.5.64.F09.1.454.light.4.raw
atcagacacgcacgaccggtgctcgatttagcgcgtatacaaggggcagactcagtcaggacacagcatggacatgagggtccccgctcagctcctggggctcctgctgctctggctcccaggtgccaaatgtgacatccaaatgacccagtctcctgccaccctgtctgcttttgtgggagacagaatcaccatcacttgccgggccagtcagactattagtacctggttggcctggtatcagcaaaaaccagggaaagcccctcgtctcctgatctttgatgcctccagtttagaaactggggtcccatcaaggttcagcggccgtggatctgggacagaattcactctcaccgtcaaacggcctgcagcctgatgattttgcaacttattactgccatcagtatagtagttttccattcaccttcggccctgggaccaaagtggatctcagtcgaactgtggctgcaccatctgtcttcatcttcccgccta

SEQ ID NO: 557792 - DNA, 502 bp, Homo sapiens; identical to SEQ ID NO: 539314
  misc_feature: HIJSMM301E2NR8.21.81.H04.1.454.light.4.raw

SEQ ID NO: 557793 - DNA, 490 bp, Homo sapiens
  misc_feature: HIJSMM301ASHS7.3.10.A10.1.454.light.4.raw
agacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcggggatccctgagcgattctctggctccagctcagggacaacagtcacgttgaccatcagtggagtccaggcagaggacgaggctgactattattgtcaatcagcagacaacagtaatacttaatctttatgtcttcggatctgggaccagggtcaccgtcctaggtcagcccaaggccaaccca

SEQ ID NO: 557794 - DNA, 508 bp, Homo sapiens
  misc_feature: HIJSMM301BAYZ1.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaacggtaggaaatacaaacgaactagtggctgcaccatctgtcttctatcttccccg

SEQ ID NO: 557795 - DNA, 487 bp, Homo sapiens
  misc_feature: HIJSMM301C70K6.49.82.H05.1.454.light.4.raw
agtcgagagacacgaccggtgctcgatttagtcgagctctctcgcgggcacgaccggtgctcgatttagtcgagctctcagagagaaaggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaaatcaacagacaccattggtacttatgtcttcggaactgccg

SEQ ID NO: 557796 - DNA, 492 bp, Homo sapiens
  misc_feature: HIJSMM301CCEHM.49.66.F11.1.454.light.4.raw
agtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccagccaggttcagtggcagtgggtttgggacagacttcacgctcaccatcagcagcctagagcctgaagattttgcagtttattactgtcaacagcgtaccacaggattcactttcggccctgggaccagagtggatatcaacgaactgtggctgcaccatctgtcttcatcttcccg

SEQ ID NO: 557797 - DNA, 484 bp, Homo sapiens; identical to SEQ ID NO: 537878
  misc_feature: HIJSMM301A9VRG.17.34.D01.1.454.light.4.raw

SEQ ID NO: 557798 - DNA, 498 bp, Homo sapiens; identical to SEQ ID NO: 547576
  misc_feature: HIJSMM301BCWK0.12.37.D04.1.454.light.4.raw

SEQ ID NO: 557799 - DNA, 480 bp, Homo sapiens; identical to SEQ ID NO: 535291
  misc_feature: HIJSMM301EK1PB.22.59.F04.1.454.light.4.raw

SEQ ID NO: 557800 - DNA, 460 bp, Homo sapiens
  misc_feature: HIJSMM301EVDA7.49.73.G07.1.454.light.4.raw
agtcgagagacacgaccggtgctcgatttagctctacgctcagggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcgtgtatctgaattggtatcagcaaaaaccagggaaagcccctgagctcctgatcctcgatgcatccaatttggaaacaggggtcccatcgaggttctctggaagtggctctgggacacattttactttcaccatcagcagactgcagcctgaagatattgcaacatattactgtcaacagtatgataatctccgctcactttcggcggagggaccaaggtggagatcaacgaa

SEQ ID NO: 557801 - DNA, 517 bp, Homo sapiens
  misc_feature: HIJSMM301DUUV8.40.87.H10.1.454.light.4.raw
tctagcgactcacgaccggtgctcgatttagcagtactgcgttgggtttggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatttcttgttctggaagcaactccaatatcggaactaattatgtatactggtaccagcagctcccaggaacggcccccaaagtcctcttctataggaataatcaacggccctcaggggtccctgaccgattctctgcctccaagtctggcacctctgtgtccctggccatcagtgggctccggtccgaagatgagggtgactattactgtgcagcttgggatgagagcctgagaggttggctgttcggcggagggaccaagctgaccgtcctaggtcagcccaaggctgccccctc

SEQ ID NO: 557802 - DNA, 501 bp, Homo sapiens; identical to SEQ ID NO: 535746
  misc_feature: HIJSMM301EB2JH.18.11.A11.1.454.light.4.raw

SEQ ID NO: 557803 - DNA, 486 bp, Homo sapiens; identical to SEQ ID NO: 535043
  misc_feature: HIJSMM301A996A.46.35.D02.1.454.light.4.raw

SEQ ID NO: 557804 - DNA, 476 bp, Homo sapiens; identical to SEQ ID NO: 537368
  misc_feature: HIJSMM301C7A3B.7.83.H06.1.454.light.4.raw

SEQ ID NO: 557805 - DNA, 506 bp, Homo sapiens; identical to SEQ ID NO: 534969
  misc_feature: HIJSMM301C1L0U.18.37.D04.1.454.light.4.raw

SEQ ID NO: 557806 - DNA, 509 bp, Homo sapiens
  misc_feature: HIJSMM301AZNPS.47.55.E11.1.454.light.4.raw
agctcacgtacacgaccggtgctcgatttagcactcgcacgttgggtttggggagagaagacaggattcaggacaatctccagcatggccggcttccctctcctcctcaccctcctcactcactgtgcagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctaggtcagcccaaggccaacccactgtcactctgttccca

SEQ ID NO: 557807 - DNA, 441 bp, Homo sapiens; identical to SEQ ID NO: 535074
  misc_feature: HIJSMM301B83CR.11.3.A03.1.454.light.4.raw

SEQ ID NO: 557808 - DNA, 441 bp, Homo sapiens; identical to SEQ ID NO: 534971
  misc_feature: HIJSMM301BJG14.11.3.A03.1.454.light.4.raw

SEQ ID NO: 557809 - DNA, 503 bp, Homo sapiens; identical to SEQ ID NO: 538884
  misc_feature: HIJSMM301AOMZ4.27.78.H01.1.454.light.4.raw

SEQ ID NO: 557810 - DNA, 518 bp, Homo sapiens
  misc_feature: HIJSMM301BMUV4.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcggccgaagggaccgaacggtggaaagtacaaacgaaacctagtggcgtgcaccaactctgttcttctactcttcccccg

SEQ ID NO: 557811 - DNA, 504 bp, Homo sapiens; identical to SEQ ID NO: 535561
  misc_feature: HIJSMM301AQ3NJ.4.57.F02.1.454.light.4.raw

SEQ ID NO: 557812 - DNA, 517 bp, Homo sapiens
  misc_feature: HIJSMM301CA2UX.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtctaggtcagcccaaggctgccccctcggtcactctgttcccgccctcctcacg

SEQ ID NO: 557813 - DNA, 448 bp, Homo sapiens; identical to SEQ ID NO: 554489
  misc_feature: HIJSMM301BB4DS.18.9.A09.1.454.light.4.raw
  modified_base (413)..(413): a, c, t, g, unknown or other

SEQ ID NO: 557814 - DNA, 447 bp, Homo sapiens; identical to SEQ ID NO: 535201
  misc_feature: HIJSMM301C3PUZ.18.9.A09.1.454.light.4.raw

SEQ ID NO: 557815 - DNA, 487 bp, Homo sapiens; identical to SEQ ID NO: 536206
  misc_feature: HIJSMM301B97BQ.47.38.D05.1.454.light.4.raw

SEQ ID NO: 557816 - DNA, 495 bp, Homo sapiens
  misc_feature: HIJSMM301AUQFP.48.35.D02.1.454.light.4.raw
agtatacatacacgaccggtgctcgatttagcacacgatagttgggtttggggtggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaagctgaccgtcctaggtcagcccaaggctg

SEQ ID NO: 557817 - DNA, 505 bp, Homo sapiens
  misc_feature: HIJSMM301AYEUB.14.57.F02.1.454.light.4.raw
cgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgcagtttattactgtcagcagcggggcaattggccgctcactttcggcgggggaccgaaggtggagttcaaacgaactgtggctgcaccatctgtcttcatcttcccgccta

SEQ ID NO: 557818 - DNA, 485 bp, Homo sapiens; identical to SEQ ID NO: 535880
  misc_feature: HIJSMM301BWBO9.7.75.G09.1.454.light.4.raw

SEQ ID NO: 557819 - DNA, 493 bp, Homo sapiens; identical to SEQ ID NO: 540693
  misc_feature: HIJSMM301DSQT9.22.65.F10.1.454.light.4.raw

SEQ ID NO: 557820 - DNA, 511 bp, Homo sapiens; identical to SEQ ID NO: 548439
  misc_feature: HIJSMM301D9Y7I.16.46.E02.1.454.light.4.raw

SEQ ID NO: 557821 - DNA, 496 bp, Homo sapiens; identical to SEQ ID NO: 535109
  misc_feature: HIJSMM301AKEGE.16.78.H01.1.454.light.4.raw

SEQ ID NO: 557822 - DNA, 508 bp, Homo sapiens; identical to SEQ ID NO: 535835
  misc_feature: HIJSMM301AZ67R.8.34.D01.1.454.light.4.raw

SEQ ID NO: 557823 - DNA, 486 bp, Homo sapiens
  misc_feature: HIJSMM301EQKG4.11.76.G10.1.454.light.4.raw
cgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaacagaagccaggccagcctccaaagcagctcatttattgggcatctactcgggattccggggtccctgaccgattccgtggcagtggatctgggacaaatttcactctcaccatcaatagcctgcaggctgaagatgtggcagcttattattgtcagcaatattatacttctcttccgatcacttttggccaggggaccaggctggagatcagacgaactgtggtcg

SEQ ID NO: 557824 - DNA, 497 bp, Homo sapiens; identical to SEQ ID NO: 536371
  misc_feature: HIJSMM301D9CIC.16.78.H01.1.454.light.4.raw

SEQ ID NO: 557825 - DNA, 486 bp, Homo sapiens; identical to SEQ ID NO: 540808
  misc_feature: HIJSMM301CFMT6.26.70.G04.1.454.light.4.raw

SEQ ID NO: 557826 - DNA, 476 bp, Homo sapiens
  misc_feature: HIJSMM301COZH8.52.1.A01.1.454.light.4.raw
cgcagtacgacacgaccggtgctcgatttagacgtctcatcaggggcagtctcagtcaggacacagcatggacatgagggtccccgctcagctcctggggctcctgctactctggctcctaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtgggtcccatcaaggttcagtggcagtggatctgggacagaattcactctcaccatcaccagtctgcaggctgaggattttgcaacttacttctgtcaacagagttacagttccctcactttcggccctgggaccatagtggatatcaaacgaactgtggctgcaccatctgtctt

SEQ ID NO: 557827 - DNA, 497 bp, Homo sapiens
  misc_feature: HIJSMM301CY9I2.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgcctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccaggggaccaagctggagatcaaacgaactgtggctgcaccatctgtt

SEQ ID NO: 557828 - DNA, 494 bp, Homo sapiens; identical to SEQ ID NO: 534994
  misc_feature: HIJSMM301DK65V.27.78.H01.1.454.light.4.raw

SEQ ID NO: 557829 - DNA, 486 bp, Homo sapiens; identical to SEQ ID NO: 535043
  misc_feature: HIJSMM301BBRG9.46.35.D02.1.454.light.4.raw

SEQ ID NO: 557830 - DNA, 495 bp, Homo sapiens; identical to SEQ ID NO: 535596
  misc_feature: HIJSMM301A18YX.10.79.H02.1.454.light.4.raw

SEQ ID NO: 557831 - DNA, 447 bp, Homo sapiens; identical to SEQ ID NO: 535020
  misc_feature: HIJSMM301AYTGN.18.9.A09.1.454.light.4.raw

SEQ ID NO: 557832 - DNA, 512 bp, Homo sapiens
  misc_feature: HIJSMM301CK9U5.7.34.D01.1.454.light.4.raw
cgtgtctctacacgaccggtgctcgatttagatcgtctgtgttgggtttggggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggactccagactgaggacgaggctgattattactgctgctcatatacaggggacagcattatttgggtgtttcggcggagggaccaagctgaccgtcctgcgtcagcccaaggctgccccctcggtcact

SEQ ID NO: 557833 - DNA, 507 bp, Homo sapiens
  misc_feature: HIJSMM301DZR51.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggcccgtggaccgaaagtggatatcaaacgaactagtggctgcaccatctgtctt

SEQ ID NO: 557834 - DNA, 501 bp, Homo sapiens; identical to SEQ ID NO: 536867
  misc_feature: HIJSMM301DCBRG.5.86.H09.1.454.light.4.raw

SEQ ID NO: 557835 - DNA, 521 bp, Homo sapiens
  misc_feature: HIJSMM301EW9VI.27.23.C01.1.454.light.4.raw
  modified_base (510)..(510): a, c, t, g, unknown or other
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactcngttcccaccct

SEQ ID NO: 557836 - DNA, 513 bp, Homo sapiens
  misc_feature: HIJSMM301AWD63.43.34.D01.1.454.light.4.raw
tgtgagtagtcacgaccggtgctcgatttagatcgtctgtgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctcccccctactaacttacgttcgaggacggaacttaggtacaatcaactaacgtacctacgttgggtcgtctcgacccaactcttcg

SEQ ID NO: 557837 - DNA, 490 bp, Homo sapiens; identical to SEQ ID NO: 538273
  misc_feature: HIJSMM301DR8F3.16.73.G07.1.454.light.4.raw

SEQ ID NO: 557838 - DNA, 445 bp, Homo sapiens
  misc_feature: HIJSMM301D5QIJ.2.76.G10.1.454.light.4.raw
acgctcgacacacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaacggcccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatggcaattgggtattcggcggagggaccaagttgaccgtcctaagtcagcccaaggctgccccctcggtcactctgttccccaccctcctctgtcgagcgt

SEQ ID NO: 557839 - DNA, 500 bp, Homo sapiens; identical to SEQ ID NO: 537851
  misc_feature: HIJSMM301CHQEI.52.37.D04.1.454.light.4.raw

SEQ ID NO: 557840 - DNA, 504 bp, Homo sapiens
  misc_feature: HIJSMM301B6S51.17.33.C11.1.454.light.4.raw
  modified_base (498)..(498): a, c, t, g, unknown or other
cgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaaacaacaaacactcctggacccctgcccgattctcaggctccctccttgggggcaaagctgccctgacactgtctggtgtgcagcctgaggacgaggctgactattactgctactctactttgtggtgctgtgctattcgcggagggaccaagctgacgtctaagtcagcccaaggctgcccctcggtcactctnttcccg

SEQ ID NO: 557841 - DNA, 463 bp, Homo sapiens; identical to SEQ ID NO: 535062
  misc_feature: HIJSMM301DG8EF.11.73.G07.1.454.light.4.raw

SEQ ID NO: 557842 - DNA, 505 bp, Homo sapiens; identical to SEQ ID NO: 535503
  misc_feature: HIJSMM301A6LSB.8.28.C06.1.454.light.4.raw

SEQ ID NO: 557843 - DNA, 486 bp, Homo sapiens; identical to SEQ ID NO: 535385
  misc_feature: HIJSMM301DQ5QJ.19.71.G05.1.454.light.4.raw

SEQ ID NO: 557844 - DNA, 493 bp, Homo sapiens; identical to SEQ ID NO: 546502
  misc_feature: HIJSMM301CA2TA.11.71.G05.1.454.light.4.raw

SEQ ID NO: 557845 - DNA, 490 bp, Homo sapiens; identical to SEQ ID NO: 535234
  misc_feature: HIJSMM301DJIY2.17.21.B10.1.454.light.4.raw

SEQ ID NO: 557846 - DNA, 501 bp, Homo sapiens
  misc_feature: HIJSMM301C999I.43.38.D05.1.454.light.4.raw
tgtgagtagtcacgaccggtgctcgatttagtatctgatagttgggtttggggagtcagacccagtcaggacacagcctggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagactattattacctggttggcctggtatcagcagaaaccagggaaagcccctaaactcctgatctttgaggcatctcgtttagaaagtggggtcccctcaaggttcagcggcagtgcatctgggacagatttcactctcaccatcagcagcctgcagcctgatgattttgcaacttattactgtcaacagtataatagttacccctggacgttcggccaagggaccagggtggaaatacaaacgaactagtgctgcacatctgtctctatccttcccg

SEQ ID NO: 557847 - DNA, 505 bp, Homo sapiens
  misc_feature: HIJSMM301CBYPV.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctcgggaccgaaagtggatatcaaacgaactgtggctgcaccatctgt

SEQ ID NO: 557848 - DNA, 504 bp, Homo sapiens; identical to SEQ ID NO: 535561
  misc_feature: HIJSMM301BJPMN.4.57.F02.1.454.light.4.raw

SEQ ID NO: 557849 - DNA, 489 bp, Homo sapiens
  misc_feature: HIJSMM301AN0VY.49.68.G02.1.454.light.4.raw
  modified_base (364)..(364): a, c, t, g, unknown or other
agtcgagagacacgaccggtgctcgatttagtcgatagtgaagggaaagggggaagagctgctcagttaggacccagagggaaccatggaaaccccagcgcagcttctcttcctcctgctactctggctcccagataccaccgcagaaattgtgttgacgcagtctccaggcaccctgtctttgtctccaggggaaagagccaccctctcctgcagggccagtcagagcgttagcaaacagttatgtagcctggtaccagcagaaacctggccagtctcccaggctcctcatctatgctgcgtccagcagggccactggcatcccggacaggttcagtggcagtgggtctgggacaggacttcnctctcaccatcagcagactggagcctgaagattttgcagtatattactgtcagcatgggagcattcgtgcgctcaccttcggcggagggaccaaggtggagagtcaaacgaactgtggctgcacc

SEQ ID NO: 557850 - DNA, 504 bp, Homo sapiens
  misc_feature: HIJSMM301D8N46.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactacttttacctcaagtgatcaccttcggccaagggacacgactggagattaaacg

SEQ ID NO: 557851 - DNA, 484 bp, Homo sapiens
  misc_feature: HIJSMM301ANM9A.46.26.C04.1.454.light.4.raw
  modified_base (459)..(459): a, c, t, g, unknown or other
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggngggaccaaggtggagatcaaacgaa

SEQ ID NO: 557852 - DNA, 493 bp, Homo sapiens; identical to SEQ ID NO: 539394
  misc_feature: HIJSMM301C9O1N.10.79.H02.1.454.light.4.raw

SEQ ID NO: 557853 - DNA, 488 bp, Homo sapiens; identical to SEQ ID NO: 536554
  misc_feature: HIJSMM301CPIGU.26.37.D04.1.454.light.4.raw

SEQ ID NO: 557854 - DNA, 506 bp, Homo sapiens
  misc_feature: HIJSMM301AID9J.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaagtggatatcaaacgaaactgtggctgcaccatctgtctt

SEQ ID NO: 557855 - DNA, 505 bp, Homo sapiens; identical to SEQ ID NO: 544483
  misc_feature: HIJSMM301AFAX0.47.83.H06.1.454.light.4.raw

SEQ ID NO: 557856 - DNA, 488 bp, Homo sapiens; identical to SEQ ID NO: 537673
  misc_feature: HIJSMM301DVWDF.12.31.C09.1.454.light.4.raw

SEQ ID NO: 557857 - DNA, 517 bp, Homo sapiens; identical to SEQ ID NO: 536980
  misc_feature: HIJSMM301CV9US.5.27.C05.1.454.light.4.raw

SEQ ID NO: 557858 - DNA, 496 bp, Homo sapiens; identical to SEQ ID NO: 535109
  misc_feature: HIJSMM301BOASV.16.78.H01.1.454.light.4.raw

SEQ ID NO: 557859 - DNA, 503 bp, Homo sapiens
  misc_feature: HIJSMM301BTI16.5.86.H09.1.454.light.4.raw
atcagacacgcacgaccggtgctcgatttagtgctatagacttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaagctgaccgtcctaggtcagcccaaggctgccccctcggcta

SEQ ID NO: 557860 - DNA, 476 bp, Homo sapiens
  misc_feature: HIJSMM301DMN6J.7.76.G10.1.454.light.4.raw
cgtgtctctacacgaccggtgctcgatttagtcactcatacagggggcaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagcccctaaactcctgatctctgctgcatccagtttacaaagtgggtcccatcgcggttcagcggcagtggatatgggacatatttcactctcgccatcagcagcctgcagcctgaagattttgcaacttactattgtcaacaggctaacagtttccgctcaccttcggcgggggaccaaggtggagatcaaacgaactgtggctgcacc

SEQ ID NO: 557861 - DNA, 499 bp, Homo sapiens; identical to SEQ ID NO: 535899
  misc_feature: HIJSMM301BOG8G.19.78.H01.1.454.light.4.raw

SEQ ID NO: 557862 - DNA, 444 bp, Homo sapiens; identical to SEQ ID NO: 539971
  misc_feature: HIJSMM301BMT4C.8.73.G07.1.454.light.4.raw
  modified_base (426)..(426): a, c, t, g, unknown or other

SEQ ID NO: 557863 - DNA, 543 bp, Homo sapiens
  misc_feature: HIJSMM301CHKEJ.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgtcgacggaccgaacggtaggaaggtacgaaacggaaaccgtaacggtaggtacgtgcgaccactactacgtcttctactcttcccgtccctacctctacgtatacg

SEQ ID NO: 557864 - DNA, 503 bp, Homo sapiens
  misc_feature: HIJSMM301CPD61.21.22.B11.1.454.light.4.raw
  modified_base (429)..(429): a, c, t, g, unknown or other
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacncaacatgggatgacaatctgagcggttgggtgttcggcgggagggaccaaactgaccgtcctaggtcagcccaa

SEQ ID NO: 557865 - DNA, 495 bp, Homo sapiens; identical to SEQ ID NO: 545773
  misc_feature: HIJSMM301A7Y21.27.78.H01.1.454.light.4.raw

SEQ ID NO: 557866 - DNA, 480 bp, Homo sapiens
  misc_feature: HIJSMM301A7R9D.48.33.C11.1.454.light.4.raw
agtatacatacacgaccggtgctcgatttagagtgagctcgttgggtttgggggggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttcgtagggaacacagccactctgaccatcagcgggacccaggctatggatgaggctgactattactgtcaggcgtgggacatcagcagtggaggttggtttcgggcgggaggaccaagcgtagaccgtacctaagtcacg

SEQ ID NO: 557867 - DNA, 501 bp, Homo sapiens
  misc_feature: HIJSMM301BNGTY.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtctttcggaattgggacgacggtcaccgtcctaggtcagcccaaggccaacccca

SEQ ID NO: 557868 - DNA, 490 bp, Homo sapiens
  misc_feature: HIJSMM301DTAS2.22.86.H09.1.454.light.4.raw
acatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgaccgtcctaggtcagcccaaggctgccccctcggtcactctgttcccgaccctcctc

SEQ ID NO: 557869 - DNA, 488 bp, Homo sapiens
  misc_feature: HIJSMM301D5AT5.48.55.E11.1.454.light.4.raw
agtatacatacacgaccggtgctcgatttagcactcgcacgttgggtttgggggaagagctgctcagttaggacccagagggaaccatggaaaccccagcgcagcttctcttcctcctgctactctggctcccagataccaccggagcacttgtgttgacgcagtctccaggcaccctgtctttgtctccaggggagagagccaccctctcctgcagggccagtcagagtgttagcggcggctccgtagcctggtaccagcagaaacgtggccaggttcccaggctcctcatctatgatgcatccagcagggccactggcatcccagacaggttcagtggcagtgggtctgggacagacttcactctcaccatcagcagactggagcctgaagattttgcagtgtattactgtcagcagtatggtagctcacctcaactcactttcggcggagggaccaaggtggagatcaaacgaactgtggctgca

SEQ ID NO: 557870 - DNA, 519 bp, Homo sapiens; identical to SEQ ID NO: 541143
  misc_feature: HIJSMM301CDXJB.7.86.H09.1.454.light.4.raw

SEQ ID NO: 557871 - DNA, 503 bp, Homo sapiens
  misc_feature: HIJSMM301AXOUE.9.53.E09.1.454.light.4.raw
tgatacgtctcacgaccggtgctcgatttagagagagtgtgttgggtttgggggctttgcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggaccaaggtgaccgtcctaggtcagcccaaggctgccccctcggtcactctgttcccaccctcctcagacgtatcac

SEQ ID NO: 557872 - DNA, 499 bp, Homo sapiens; identical to SEQ ID NO: 537800
  misc_feature: HIJSMM301DPAN8.22.38.D05.1.454.light.4.raw

SEQ ID NO: 557873 - DNA, 478 bp, Homo sapiens
  misc_feature: HIJSMM301DNCSO.12.1.A01.1.454.light.4.raw
atacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaaggttcagtggcagtgggtctgggacagatttcactctcaccatcagcagtctgcaacctgaagattctgcaacttattactgtcaacagagtaacagttaccctcccactttcggcggagggaccaaggtggagatcaaacgaaactgtggctgcaccatctgtt

SEQ ID NO: 557874 - DNA, 518 bp, Homo sapiens; identical to SEQ ID NO: 539372
  misc_feature: HIJSMM301DPG1O.7.86.H09.1.454.light.4.raw

SEQ ID NO: 557875 - DNA, 495 bp, Homo sapiens
  misc_feature: HIJSMM301DKCAG.5.57.F02.1.454.light.4.raw
atcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtcaacaatgtggtcagtggcctcgaacgttcggcccagggaccacacgtggataatcaggcgaactgtggctgcaccatctgtctt

SEQ ID NO: 557876 - DNA, 490 bp, Homo sapiens; identical to SEQ ID NO: 535420
  misc_feature: HIJSMM301CQJ89.3.72.G06.1.454.light.4.raw

SEQ ID NO: 557877 - DNA, 487 bp, Homo sapiens
  misc_feature: HIJSMM301CKDPG.14.53.E09.1.454.light.4.raw
cgtctagtaccacgaccggtgctcgatttagagagagtgtgttgggtttggggggggagcctagctgtgctgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgctttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttatcgggtgttcggcggagggaccaagctgaccgtccta

SEQ ID NO: 557878 - DNA, 499 bp, Homo sapiens
  misc_feature: HIJSMM301AGHI4.13.81.H04.1.454.light.4.raw
tcacgtactacacgaccggtgctcgatttagtagtgtagattcgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggagtccccagccgcttctctggatccaaggatgattccgccaacgcagggatattactcatctctgggctccagtctgacgatgaggctgactattactgtttgacttggcacaacaacgcctggatcttcggacctgggaccacggtcaccgtcctaggtcagcccaaggccaacccactgtcact

SEQ ID NO: 557879 - DNA, 499 bp, Homo sapiens
  misc_feature: HIJSMM301DAJWT.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccaaggaccgaaggtggaaatcaaacgaactagtggctgcacc

SEQ ID NO: 557880 - DNA, 447 bp, Homo sapiens; identical to SEQ ID NO: 535020
  misc_feature: HIJSMM301CBKJD.18.9.A09.1.454.light.4.raw

SEQ ID NO: 557881 - DNA, 493 bp, Homo sapiens
  misc_feature: HIJSMM301B59YG.5.40.D07.1.454.light.4.raw
atcagacacgcacgaccggtgctcgatttagtgatagagcgtaacaacagagggggaggaactgctcagttaggacccagacggaaccatggaagccccagcgcagcttctcttcctcctgctactctggctcccagataccattggagagatagtgatgacgcagtctccagccaccctgtctgtgtctccaggggaaagagccaccctctcctgcagggccagccagagtgtaagtagtaggttagcctggtatcagcagaagccagggaaagcccctaaactcctgatctatgctgcatccagtttgcaaagtggggtcccatcgaggttcagcggcagtggatctgggacagatttcactctcaccatcagcaggctgcagcccgaagattttgcaacttactattgtcaaaatactaacagtctcccgcgcagttttggccaggggaccaaagtggagatcaaacgaactgtggctgcaccatctgtt

SEQ ID NO: 557882 - DNA, 493 bp, Homo sapiens; identical to SEQ ID NO: 535084
  misc_feature: HIJSMM301DT2QW.47.64.F09.1.454.light.4.raw

SEQ ID NO: 557883 - DNA, 499 bp, Homo sapiens
  misc_feature: HIJSMM301BXCC4.9.71.G05.1.454.light.4.raw
tgatacgtctcacgaccggtgctcgatttagtgtcgtcgcaagagagaggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcgagggaccaggctgaccgtcctgagtcagcccaaggctgcccccc

SEQ ID NO: 557884 - DNA, 507 bp, Homo sapiens
  misc_feature: HIJSMM301CRSD4.2.35.D02.1.454.light.4.raw
  modified_base (227)..(227): a, c, t, g, unknown or other
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagaaacngtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcggagggaccaagctgaccgtcctgggtcagcccaaggctgccccctcggtcta

SEQ ID NO: 557885 - DNA, 502 bp, Homo sapiens
  misc_feature: HIJSMM301EN495.21.81.H04.1.454.light.4.raw
tcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacgaggctgattattactgcaggtcatatacaatcagcaaacacttatgtcttcgggactgggaccaagatcaccgtcctaggtcagcccaaggccaacccactgtca

SEQ ID NO: 557886 - DNA, 488 bp, Homo sapiens; identical to SEQ ID NO: 537527
  misc_feature: HIJSMM301CMBLU.26.78.H01.1.454.light.4.raw

SEQ ID NO: 557887 - DNA, 490 bp, Homo sapiens
  misc_feature: HIJSMM301DP3O2.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaaggaccaaagtggacatcaagcgaactgtggctgcaccatctgtt

SEQ ID NO: 557888 - DNA, 505 bp, Homo sapiens
  misc_feature: HIJSMM301AS80B.5.24.C02.1.454.light.4.raw
atcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaagctgaccgtcctaggtcagcccaaggctgcccccg

SEQ ID NO: 557889 - DNA, 497 bp, Homo sapiens
  misc_feature: HIJSMM301A6SXC.3.33.C11.1.454.light.4.raw
agacgcactccacgaccggtgctcgatttagagtgagctcgttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccccg

SEQ ID NO: 557890 - DNA, 487 bp, Homo sapiens; identical to SEQ ID NO: 537220
  misc_feature: HIJSMM301CAFTH.16.53.E09.1.454.light.4.raw

SEQ ID NO: 557891 - DNA, 506 bp, Homo sapiens
  misc_feature: HIJSMM301EVT35.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcgccgaagggaccaaggtaggaaagtacaaacgaactagtggctgcaccatctgtcttcatcttccccg

SEQ ID NO: 557892 - DNA, 507 bp, Homo sapiens; identical to SEQ ID NO: 541461
  misc_feature: HIJSMM301EQDI1.11.57.F02.1.454.light.4.raw

SEQ ID NO: 557893 - DNA, 494 bp, Homo sapiens; identical to SEQ ID NO: 534992
  misc_feature: HIJSMM301AVA0W.9.1.A01.1.454.light.4.raw

SEQ ID NO: 557894 - DNA, 496 bp, Homo sapiens
  misc_feature: HIJSMM301DVQEN.15.25.C03.1.454.light.4.raw
tctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggttctaatcgggcctccggggtccctgacaggttcagtggcagtggatcaggcatagattttacactgaaaatcagcagagtggaggctgaggacgttggggtttattactgcatgcaggtctacaaaccccgatcaccttcggccgaggacacgcctggagattaaacgaactgtggctgcaccat

SEQ ID NO: 557895 - DNA, 482 bp, Homo sapiens; identical to SEQ ID NO: 535216
  misc_feature: HIJSMM301DVF0S.17.26.C04.1.454.light.4.raw

SEQ ID NO: 557896 - DNA, 504 bp, Homo sapiens
  misc_feature: HIJSMM301DIIJL.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggaggaccgaaaatagaggtcgaacgaaactgtggctgcaccatctgtcttcatt

SEQ ID NO: 557897 - DNA, 485 bp, Homo sapiens; identical to SEQ ID NO: 538956
  misc_feature: HIJSMM301ESI6C.40.69.G03.1.454.light.4.raw

SEQ ID NO: 557898 - DNA, 495 bp, Homo sapiens
  misc_feature: HIJSMM301BYXNA.12.38.D05.1.454.light.4.raw
atacgacgtacacgaccggtgctcgatttagtatctgatagttgggtttgggggaactgctcagttaggacccagacggaaccatggaagccccagcgcagcttctcttcctcctgctactctggctcccagattcctctggagaagttgtgatgacgcagtctccagccaccctgtctgcgtctccaggggaaagagtcaccctctcatgcagggccagtgagattgttaccaccaacttagcctggtaccaacagaaacctggccagcctcccaggctcctcatttatggtgcatccacaagggccgctggtgtcccagccaggttcagtggcagtggatctgcgacagagttcactctcaccgtcagcagcctgcagtctgaagattttgcagtttattactgtcagcagtatgagaagtggttcaagactttcggcggagggaccaaggtggagatcaaacgaactagtggctgcaccatctgtcttcatt

SEQ ID NO: 557899 - DNA, 497 bp, Homo sapiens
  misc_feature: HIJSMM301BZI88.47.36.D03.1.454.light.4.raw
agctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacttgtcgggcgagtcagggtattagcaactggttagcctggtatcaacagaaaccagggaaagcccctaacctcctcatctctactgcatccactttgcaaagtggggtcccatcaaggttcagcggcagtggatctgggacagatttcactctcactatcagcagcctgcagcctgaagattttggaacttattattgtcaacagggtaacagttccgtctcaccttcggtcggagggaccgaaggtaggagatagaaagaaacgtagtggcgtgcaccaact

SEQ ID NO: 557900 - DNA, 503 bp, Homo sapiens; identical to SEQ ID NO: 541454
  misc_feature: HIJSMM301AMY94.9.12.B01.1.454.light.4.raw

SEQ ID NO: 557901 - DNA, 480 bp, Homo sapiens; identical to SEQ ID NO: 535442
  misc_feature: HIJSMM301D8AY4.41.17.B06.1.454.light.4.raw

SEQ ID NO: 557902 - DNA, 444 bp, Homo sapiens; identical to SEQ ID NO: 535192
  misc_feature: HIJSMM301E1ILV.5.9.A09.1.454.light.4.raw

SEQ ID NO: 557903 - DNA, 487 bp, Homo sapiens; identical to SEQ ID NO: 535299
  misc_feature: HIJSMM301DF0VP.21.55.E11.1.454.light.4.raw

SEQ ID NO: 557904 - DNA, 441 bp, Homo sapiens; identical to SEQ ID NO: 534971
  misc_feature: HIJSMM301C2W8H.11.3.A03.1.454.light.4.raw

SEQ ID NO: 557905 - DNA, 447 bp, Homo sapiens; identical to SEQ ID NO: 535201
  misc_feature: HIJSMM301EMMAL.18.9.A09.1.454.light.4.raw

SEQ ID NO: 557906 - DNA, 497 bp, Homo sapiens; identical to SEQ ID NO: 540789
  misc_feature: HIJSMM301AXAY1.9.67.G01.1.454.light.4.raw

SEQ ID NO: 557907 - DNA, 487 bp, Homo sapiens
  misc_feature: HIJSMM301BDQ31.5.40.D07.1.454.light.4.raw
atcagacacgcacgaccggtgctcgatttagtgatagagcgtaacaacagaggggggaactgctcagttaggacccagacggaaccatggaagccccagcgcagcttctcttcctcctgctactctggctcccagataccattggagagatagtgatgacgcagtctccagccaccctgtctgtgtctccaggggaaagagccaccctctcctgcagggccagccagagtgtaagtagtaggttagcctggtatcagcagaaacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcaacagtataatgactggtggacgttcggccaagggaccaaggtggagaccaaacgaactgtggctgcaccatctgt

SEQ ID NO: 557908 - DNA, 484 bp, Homo sapiens; identical to SEQ ID NO: 535400
  misc_feature: HIJSMM301BUG8X.46.26.C04.1.454.light.4.raw

SEQ ID NO: 557909 - DNA, 473 bp, Homo sapiens
  misc_feature: HIJSMM301EOIZI.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagatttaatttcaccatcagcagcctccaacgtgatgatgttgcaacatactattgtcagcaatatgattttgcttcctccgagtgccacttttggcggggggaccaaggtggacatcaaacgaaa

SEQ ID NO: 557910 - DNA, 502 bp, Homo sapiens
  misc_feature: HIJSMM301ESZED.51.87.H10.1.454.light.4.raw
cgatcgtatacacgaccggtgctcgatttagcagtactgcgttgggtttgggggaggaactgctcagttaggacccagagggaaccatggaagccccagctcagcttctcttcctcctgctactctggctcccagattccaccggagaaattgtgttgacacagtctccaggcaccctgtctttgtctccaggggaaagagccaccctctcctgcagggccagtcagagtgttagtcacttcttagcctggtaccaacacaaacctggccaggctcccaggctcctcatttatgatgcatccaagagggccactggcgtcccagccaggttcagtggcagtgggtctgggacagacttcactctcaccatcagcagcctagagcctgaagattttgcaatttattactgtcagcagcgtagcaattggcctccctcgatcaccttcggccaagggacacgactggagaataaacgaactgtggctgcaccatctgtcttcta

SEQ ID NO: 557911 - DNA, 495 bp, Homo sapiens
  misc_feature: HIJSMM301BXQDY.48.73.G07.1.454.light.4.raw
agtatacatacacgaccggtgctcgatttagctctacgctcagggcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggaggga

SEQ ID NO: 557912 - DNA, 516 bp, Homo sapiens
  misc_feature: HIJSMM301BTP7U.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctcgccccctcggtcactctgttcccgccctcctcc

SEQ ID NO: 557913 - DNA, 496 bp, Homo sapiens; identical to SEQ ID NO: 535423
  misc_feature: HIJSMM301A0GI4.3.33.C11.1.454.light.4.raw

SEQ ID NO: 557914 - DNA, 491 bp, Homo sapiens
  misc_feature: HIJSMM301EHGQO.17.39.D06.1.454.light.4.raw
cgtagactagcacgaccggtgctcgatttagtgacatctcgcagttctttggggggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttggcagcaacttagcctggtatcagcagaaacctggccaggctcccaggctcctcatgtatggtgcatctaccagggccactggtgtcccagccaggttcagtggcagtgggtctgggacagagttctctctcatcatcagcagcctgcagtctgaagattttgcggtttattactgtcagcagtataatcagtggcctccgtggacgttcggccagggaccaaggtaggaagtacaaacgaactagtggctgca

SEQ ID NO: 557915 - DNA, 495 bp, Homo sapiens; identical to SEQ ID NO: 545507
  misc_feature: HIJSMM301BL06B.49.22.B11.1.454.light.4.raw

SEQ ID NO: 557916 - DNA, 480 bp, Homo sapiens
  misc_feature: HIJSMM301CX9DP.51.76.G10.1.454.light.4.raw
cgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggccactgatatcccagccaggttcagtggcagtgggtctgggacagagttcactctcaccatcagcagcctgcagtctgaagattttgcaatttattactgtcagcagtataataactggcctccgtacacttttggccaggggaccaagctggagatcaaacgaactgtggctgcacc

SEQ ID NO: 557917 - DNA, 513 bp, Homo sapiens; identical to SEQ ID NO: 535849
  misc_feature: HIJSMM301B2WSY.10.80.H03.1.454.light.4.raw

SEQ ID NO: 557918 - DNA, 500 bp, Homo sapiens
  misc_feature: HIJSMM301CCRDT.40.80.H03.1.454.light.4.raw
  modified_base (239)..(239): a, c, t, g, unknown or other
tctagcgactcacgaccggtgctcgatttagctgtgcgtcgaagggaaagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagaagcattgccaaaaaatntgcttattggtaccaacagaagtcaggccaggcccctgtgctggtcatctatgaggacaacaaacgaccctccgagatccctgagagattctctggctccagctcagggacaatggccacttggctctcagtgggcccaggtggaggatgaagctgactactactgttactcagtggacagcagtggaaatcatgggtattcggcggagggaccaagctgaccgtcctaggtcagcccaaggctgccccctcggtctaccg

SEQ ID NO: 557919 - DNA, 503 bp, Homo sapiens
  misc_feature: HIJSMM301AFRMO.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctggattattactgcagctcatatgcaggcagcagcaatgtacttttcggcggagggaccaagctgaccgtcctgggtcagcccaaggctgcccctcggtca

SEQ ID NO: 557920 - DNA, 491 bp, Homo sapiens
  misc_feature: HIJSMM301DFKXS.4.27.C05.1.454.light.4.raw
agcactgtagcacgaccggtgctcgatttagacgcgatcgaagggtttgggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcgtcctacatagtaatggatacaactatttggattggtacctgcagaagccagggcagtctccacagctcctgatctatttgggttctaaccgggcctccggggtccctgacaggttcagtggcagtggatcaggcacagattttacactgagaatcagcagagtggaggctgaggatgttggggtttactactgcatgcaagctctacaagccacctacacttttggccaggggaccaggctggaggatcaaacgaactgtggcg

SEQ ID NO: 557921 - DNA, 494 bp, Homo sapiens; identical to SEQ ID NO: 540664
  misc_feature: HIJSMM301CNX9R.47.64.F09.1.454.light.4.raw

SEQ ID NO: 557922 - DNA, 493 bp, Homo sapiens; identical to SEQ ID NO: 535047
  misc_feature: HIJSMM301BVB03.16.53.E09.1.454.light.4.raw

SEQ ID NO: 557923 - DNA, 525 bp, Homo sapiens
  misc_feature: HIJSMM301DQYOA.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggtccgacgggaccgaacggtaggaaggtacgtaaacgaaacgtagtggtcgtcgcaccactctcgtcttctactcttcccgtccact

SEQ ID NO: 557924 - DNA, 500 bp, Homo sapiens
  misc_feature: HIJSMM301EA20J.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctccttcagacgttcggccaagggaccaagggtggaaatcaaacgaactgtggctgcaccta

SEQ ID NO: 557925 - DNA, 473 bp, Homo sapiens; identical to SEQ ID NO: 535262
  misc_feature: HIJSMM301C44ZG.8.67.G01.1.454.light.4.raw

SEQ ID NO: 557926 - DNA, 510 bp, Homo sapiens; identical to SEQ ID NO: 538614
  misc_feature: HIJSMM301AWTOY.19.59.F04.1.454.light.4.raw

SEQ ID NO: 557927 - DNA, 490 bp, Homo sapiens; identical to SEQ ID NO: 541141
  misc_feature: HIJSMM301EO424.47.38.D05.1.454.light.4.raw

SEQ ID NO: 557928 - DNA, 488 bp, Homo sapiens
  misc_feature: HIJSMM301CM1QV.47.48.E04.1.454.light.4.raw
agctcacgtacacgaccggtgctcgatttagagagcgtcacagagagaaggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttcggtccaaggaccgaaggtaggaaagtacaaacgaactagtggcgtgcacca

SEQ ID NO: 557929 - DNA, 495 bp, Homo sapiens
  misc_feature: HIJSMM301ADX4V.43.9.A09.1.454.light.4.raw
tgtgagtagtcacgaccggtgctcgatttagcgagacgcgcagggggagagactgaagaacccagcattgcagcagctccaccatggcctgggctcctctgctcctcaccctcctcagtctcctcacagggtccctctcccagcttgtgctgactcagccaccttctgcatcagcctccctgggagcctcggtcacactcacctgcaccctgagcagcggctacaatgaatataaggtggactggtaccaacagagaccaggggagtgcccccgatttgtgatgcgagtgggcccggatgggatggcgggatccaagggggatggcatccctgatcggttctcagtcttgggctcaggcctgactcggtccctgaccatcaacaacatccaggaagaggatgacagtgactactactgtgggacgaattatggcagtgggaatacctacatgtatgtctttggaagtgggacgaaggtcaccgtccaaggtcacg

SEQ ID NO: 557930 - DNA, 504 bp, Homo sapiens
  misc_feature: HIJSMM301CNXI7.49.82.H05.1.454.light.4.raw
agtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaactcatcatttatgaggccgatcagcggccctcaggggtctctgatcgcttctctggctccacgtctggcagcacggcctccctgacaatctctgggctccaggctggggacgaggctgattattattgctgttcatatgccggtgatagtggccgaagggtgttcggcggagggaccaaggtgaccggtcctaggtcagcccaaggctgccccctcggt

SEQ ID NO: 557931 - DNA, 499 bp, Homo sapiens
  misc_feature: HIJSMM301AK8PF.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccgagggaccgaagctggagatacaaacgaactgtggctgcaccatctgtt

SEQ ID NO: 557932 - DNA, 496 bp, Homo sapiens; identical to SEQ ID NO: 537513
  misc_feature: HIJSMM301EKMRW.12.87.H10.1.454.light.4.raw

SEQ ID NO: 557933 - DNA, 484 bp, Homo sapiens
  misc_feature: HIJSMM301BZD2G.41.35.D02.1.454.light.4.raw
tctatactatcacgaccggtgctcgatttagcacacgatagttgggtttgggggagtcagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaccagggaaagcccctaaattcctgatctatcaggcatctaatttggaaagtggggtcccatcaaggtttagcggcagtggatctgggacagaattcactctcacgatcagcggcctgcagcctgatgatgtcgcaacttattactgccaacactatgatagttacccgctcactttcggcggagggaccgaaggtggaggtcaagcgaactgtggctgcacca

SEQ ID NO: 557934 - DNA, 505 bp, Homo sapiens; identical to SEQ ID NO: 539292
  misc_feature: HIJSMM301DW1Z0.19.85.H08.1.454.light.4.raw

SEQ ID NO: 557935 - DNA, 508 bp, Homo sapiens
  misc_feature: HIJSMM301B1TV9.9.33.C11.1.454.light.4.raw
tgatacgtctcacgaccggtgctcgatttagagtgagctcgttgggtttgggggaggaactgctcagttaggacccagagggaaccatggaagccccagctcagcttctcttcctcctgctactctggatcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaaattgagatcaaacgaactgtggctgcaccatctgtcttcatctcccg

SEQ ID NO: 557936 - DNA, 504 bp, Homo sapiens
  misc_feature: HIJSMM301DRXDV.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccactgtcta

SEQ ID NO: 557937 - DNA, 447 bp, Homo sapiens; identical to SEQ ID NO: 535201
  misc_feature: HIJSMM301CAB85.18.9.A09.1.454.light.4.raw

SEQ ID NO: 557938 - DNA, 488 bp, Homo sapiens; identical to SEQ ID NO: 538612
  misc_feature: HIJSMM301ESAUI.4.59.F04.1.454.light.4.raw

SEQ ID NO: 557939 - DNA, 497 bp, Homo sapiens; identical to SEQ ID NO: 536371
  misc_feature: HIJSMM301AIH3Y.16.78.H01.1.454.light.4.raw

SEQ ID NO: 557940 - DNA, 473 bp, Homo sapiens; identical to SEQ ID NO: 535262
  misc_feature: HIJSMM301ETZ9M.8.67.G01.1.454.light.4.raw

SEQ ID NO: 557941 - DNA, 503 bp, Homo sapiens
  misc_feature: HIJSMM301CL7NB.15.86.H09.1.454.light.4.raw
tctacgtagccacgaccggtgctcgatttagtgctatagacttgggtttgggggacttccctggtctccttctacctactgcccttcatttcttccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctggtcactctgttcccaccctcctcg

SEQ ID NO: 557942 - DNA, 441 bp, Homo sapiens; identical to SEQ ID NO: 534971
  misc_feature: HIJSMM301A3LND.11.3.A03.1.454.light.4.raw

SEQ ID NO: 557943 - DNA, 497 bp, Homo sapiens; identical to SEQ ID NO: 543801
  misc_feature: HIJSMM301DXDNK.43.71.G05.1.454.light.4.raw

SEQ ID NO: 557944 - DNA, 492 bp, Homo sapiens
  misc_feature: HIJSMM301EOPN2.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttatactgtcatcagagtactactttacctcaagtgatcaccttcggccaagggacacgactggagattaaacgaactgtgctgcaccatctgtctt

SEQ ID NO: 557945 - DNA, 492 bp, Homo sapiens; identical to SEQ ID NO: 541747
  misc_feature: HIJSMM301C1XOE.19.71.G05.1.454.light.4.raw

SEQ ID NO: 557946 - DNA, 503 bp, Homo sapiens; identical to SEQ ID NO: 538973
  misc_feature: HIJSMM301AJQB8.5.86.H09.1.454.light.4.raw

SEQ ID NO: 557947 - DNA, 499 bp, Homo sapiens
  misc_feature: HIJSMM301DEU3T.52.34.D01.1.454.light.4.raw
cgcagtacgacacgaccggtgctcgatttagatcgtctgtgttgggtttgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtattagcaactacttagcctggtaccaacagaaacctggccaggctcccaggctcctcatctatgatgcgtccaacagggccactggcatcccagccaggttcagtggcggtgggtctgggacagacttcactctcaccatcagcagcctagagcctgaagattttgcagtttattactgtcagcagcgtagcaactggcctccgatcaccttcggccaagggcacgactggagattaaacgaactgtggctgcaccatctgtcttcatt

SEQ ID NO: 557948 - DNA, 488 bp, Homo sapiens; identical to SEQ ID NO: 537059
  misc_feature: HIJSMM301EFD91.47.38.D05.1.454.light.4.raw

SEQ ID NO: 557949 - DNA, 512 bp, Homo sapiens
  misc_feature: HIJSMM301EDM6T.10.28.C06.1.454.light.4.raw
catagtagtgcacgaccggtgctcgatttagagctcacgtattgggtttgggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagcccccaaactgatgatttatgatgtcagtaatcgaccctcaggggtttctgatcgcttctttgcctccaagtctggcaacacggcctccctgaccatctctgggctccagactgaggacgaggctgattattactgcagctcacatacaagcggcagcggttgggtgttcggcgggggaccgacactgaccgtcctaggtcagcccaaggctgcccctccggtcactctgtt

SEQ ID NO: 557950 - DNA, 486 bp, Homo sapiens
  misc_feature: HIJSMM301BTCU2.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctcgttcccaccctcctcgctacgtaga

SEQ ID NO: 557951 - DNA, 498 bp, Homo sapiens
  misc_feature: HIJSMM301D5VS6.7.5.A05.1.454.light.4.raw
cgtgtctctacacgaccggtgctcgatttagatagatagacagggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggtttccgtaatcgcttctctggctccaagtctggcgacacggcctccctgaccatctctgggctccaggctgaagacgaggctgattattactgcagctcatatacaggcagcagcactcaggttttcggcggagggaccaagctgaccgtcctaggtcagcccaaggctcgccccctcggt

SEQ ID NO: 557952 - DNA, 511 bp, Homo sapiens; identical to SEQ ID NO: 541549
  misc_feature: HIJSMM301D8NB9.40.33.C11.1.454.light.4.raw

SEQ ID NO: 557953 - DNA, 502 bp, Homo sapiens
  misc_feature: HIJSMM301A3EBF.15.57.F02.1.454.light.4.raw
tctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaccaagctgaccgtcctaggtcagcccaaggctgccccctcggtcactctgttcccgccctcctcgctacgtaga

SEQ ID NO: 557954 - DNA, 493 bp, Homo sapiens
  misc_feature: HIJSMM301DL7M4.40.11.A11.1.454.light.4.raw
tctagcgactcacgaccggtgctcgatttagctacgactgcaggggcagcaagatggtgttgcagacccaggtcttcatttttctgttgctctggatctctggtgcctacggggacatcgtgatgacccagtctccagactccctggctgtgtctctgggcgagagggccaccatcaactgcaagtccagccagagtcttttatacaactccaacaagcagcactacttagcttggtaccagcagaaaccaggacagcctcctaaactgctcatttactgggcctctacccgggaatccggggtccctgaccgattcagtggcagcgggtctgggacagatttcactctgaccatcagcagcctgcaggctgaagatgtggcagtttattactgtcaacaatattatattattccgaggacgttcggccaagggaccaaggtggaaatcaaacgaactagtggctgcaccatctgtcttcatcttcccgccat

SEQ ID NO: 557955 - DNA, 509 bp, Homo sapiens
  misc_feature: HIJSMM301DT23Y.13.11.A11.1.454.light.4.raw
tcacgtactacacgaccggtgctcgatttagctacgactgcaggggagcttcagctgtggtagagaagacaggattcaggacaatctccagcatggccggcttccctctcctcctcaccctcctcactcactgtgcagggtcctgggcccagtctgtgctgactcagccaccctcagcgtctgggacccccgggcagagtgtcaccatctcttgttctggaggcagtgccaacatcgggagtaattatgcattctggtatcaacaactcccaggaacggcccccagactcctcatctatagcaataaccagcggccctcaggggtccctgaccgattctctggctccaagtctggcacctcagcctccctggccatcagtgggctccggtccgacgatgaggctgattattactgttcagcttgggatgacagcctggaatacttgggttttcggcggagggaccaagttgaccgccctaggtcagcccaaggctgccccctcggtcta

SEQ ID NO: 557956 - DNA, 505 bp, Homo sapiens; identical to SEQ ID NO: 536254
  misc_feature: HIJSMM301DBAGI.7.71.G05.1.454.light.4.raw

SEQ ID NO: 557957 - DNA, 492 bp, Homo sapiens
  misc_feature: HIJSMM301DR7BR.22.65.F10.1.454.light.4.raw
acatacgcgtcacgaccggtgctcgatttagctacgctctaagggggagtcagtcgtcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagattttcgcaacttactactgtcaacagacttacagtgcccccccgatcaccttcggccaagggacacgactggagattaaacgaactgtggctgcaccatctgtcttcat

SEQ ID NO: 557958 - DNA, 447 bp, Homo sapiens
  misc_feature: HIJSMM301AH4MB.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactagtaccagcagcttccggggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccaccctcctccatactcgta

SEQ ID NO: 557959 - DNA, 473 bp, Homo sapiens
  misc_feature: HIJSMM301AKZJ5.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagcctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctcctccgagtgccacttttggcggggggaccgaaggtggacatcaaacgaa

SEQ ID NO: 557960 - DNA, 492 bp, Homo sapiens
  misc_feature: HIJSMM301BK27C.43.55.E11.1.454.light.4.raw
tgtgagtagtcacgaccggtgctcgatttagcactcgcacgttgggtttgggggcagaagtctctctcagtcaggacacagcatggacatgagggtccctgctcagctcctgggactcccgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctcccccctacaatttcggtcaggggaccaagttgaacatcaatcgaactgtggctgcaccatctgt

SEQ ID NO: 557961 - DNA, 501 bp, Homo sapiens
  misc_feature: HIJSMM301DJAUN.52.86.H09.1.454.light.4.raw
cgcagtacgacacgaccggtgctcgatttagtgctatagacttgggtttgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtattagcaactacttagcctggtaccaacagaaacctggccaggctcccaggctcctcatctatgatgcgtccaacagggccactggcatcccagccaggttcagtggcggtgggtctgggacagacttcactctcaccatcagcagcctagagcctgaagattttgcagtttattactgtcagcagcgtagcaactggcctccgatcaccttcggccaagggacacgactggagattaaacgaactgtggctgcaccatctgtccttcatt

SEQ ID NO: 557962 - DNA, 510 bp, Homo sapiens
  misc_feature: HIJSMM301AL9HA.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggccactctgttccca

SEQ ID NO: 557963 - DNA, 493 bp, Homo sapiens
  misc_feature: HIJSMM301BE39F.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctactcttttctcttcggaactgggaccacggtcaccgtctaggtcagcccaaggccaaccc

SEQ ID NO: 557964 - DNA, 444 bp, Homo sapiens; identical to SEQ ID NO: 535594
  misc_feature: HIJSMM301BUI0Z.9.9.A09.1.454.light.4.raw

SEQ ID NO: 557965 - DNA, 503 bp, Homo sapiens
  misc_feature: HIJSMM301B3XR5.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactgtggctgcacatctgtcttcatcttccgcc

SEQ ID NO: 557966 - DNA, 488 bp, Homo sapiens; identical to SEQ ID NO: 535125
  misc_feature: HIJSMM301DJSTI.17.25.C03.1.454.light.4.raw

SEQ ID NO: 557967 - DNA, 494 bp, Homo sapiens
  misc_feature: HIJSMM301A95ML.11.81.H04.1.454.light.4.raw
cgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagttttttactgtcagcagtatagtaactggcctccgtacacttttggccaggggaccaagctagaaatcaaacgaactgtggctgcaccatctgtcttca

SEQ ID NO: 557968 - DNA, 442 bp, Homo sapiens
  misc_feature: HIJSMM301AK1RD.47.55.E11.1.454.light.4.raw
agctcacgtacacgaccggtgctcgatttagcactcgcacgtagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctaggtcagcccaaggccaaccccactgtcactctgttcccgacctcctctacgtgagct

SEQ ID NO: 557969 - DNA, 472 bp, Homo sapiens; identical to SEQ ID NO: 550621
  misc_feature: HIJSMM301CHO5Q.41.8.A08.1.454.light.4.raw

SEQ ID NO: 557970 - DNA, 486 bp, Homo sapiens
  misc_feature: HIJSMM301BQC2E.46.23.C01.1.454.light.4.raw
actagcagtacacgaccggtgctcgatttagtacacgtgattagggattgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaaacgaactgtggctgcaccat

SEQ ID NO: 557971 - DNA, 496 bp, Homo sapiens
  misc_feature: HIJSMM301B3XS5.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaacgtggtggctgcaccatctgtcttcatcttccccg

SEQ ID NO: 557972 - DNA, 507 bp, Homo sapiens; identical to SEQ ID NO: 541461
  misc_feature: HIJSMM301AIZQY.11.57.F02.1.454.light.4.raw

SEQ ID NO: 557973 - DNA, 502 bp, Homo sapiens
  misc_feature: HIJSMM301CLPWP.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctggaccaaattgagatcaaacgaactgtggctgcaccatctgtcttcatcttcccgcc

SEQ ID NO: 557974 - DNA, 485 bp, Homo sapiens; identical to SEQ ID NO: 535880
  misc_feature: HIJSMM301D5ZYY.7.75.G09.1.454.light.4.raw

SEQ ID NO: 557975 - DNA, 495 bp, Homo sapiens; identical to SEQ ID NO: 535007
  misc_feature: HIJSMM301C5JYR.22.5.A05.1.454.light.4.raw

SEQ ID NO: 557976 - DNA, 490 bp, Homo sapiens
  misc_feature: HIJSMM301AQFUR.26.12.B01.1.454.light.4.raw
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaataatgatgactcagtctccaggcaccctgtctgtgtctccaggggaaagagtcaccctctcctgcagggccagtcagagtgttagtaacaacttagcctggtaccaacagaaacctggccaggctcccaggctcctcatctatgatgcatccaacagggccactggcatcccagccaggttcagtggcagtgagtctgggacagacttcactctcaccaccagcagcctagagcctgaagattttgcactttattactgtcagcagcgtagcaactggcctctcactttcggcggagggaccagggtggaggatcagacgaactgtggctgca

SEQ ID NO: 557977 - DNA, 498 bp, Homo sapiens
  misc_feature: HIJSMM301DLRLB.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggttcctgatcgcttctctgcctccaagtctggcaacacggcctccctgaccgtctctgggctccagcctgaggatgaggctgattattactgcagctcatatgcaggcatcaacactgttttcggcggagggaccaagctgaccgtccctaggtcagcccaaggctgccccctcggtccactctgttcccaccctcctcgagtgcgtct

SEQ ID NO: 557978 - DNA, 488 bp, Homo sapiens; identical to SEQ ID NO: 551347
  misc_feature: HIJSMM301DMD4T.22.65.F10.1.454.light.4.raw

SEQ ID NO: 557979 - DNA, 454 bp, Homo sapiens; identical to SEQ ID NO: 535005
  misc_feature: HIJSMM301DL9LT.19.86.H09.1.454.light.4.raw

SEQ ID NO: 557980 - DNA, 448 bp, Homo sapiens; identical to SEQ ID NO: 557440
  misc_feature: HIJSMM301DSTJI.11.86.H09.1.454.light.4.raw

SEQ ID NO: 557981 - DNA, 501 bp, Homo sapiens
  misc_feature: HIJSMM301C9CQF.13.10.A10.1.454.light.4.raw
tcacgtactacacgaccggtgctcgatttagcgtcgatctcagggggggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatctacaacacaaacactcgctcttctggggtccctcatcgcttctctggctccatccttgggaacaaagctgcccttatcatcacgggggcccaggcagaagatgaatctgattattactgtgttctttatatgggtagtgccatttctgctgtgttcggaggaggcacccggctgaccgtcctcggtcagcccaaggctgccccatcc

SEQ ID NO: 557982 - DNA, 488 bp, Homo sapiens
  misc_feature: HIJSMM301AHUG8.4.59.F04.1.454.light.4.raw
agcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcaccttctctggagataaattgggccataaatttgcttcctggtatcagcagaagccaggccagtcccctatactggtcatctatcaagataccaagcggccctcagggatccctgagcgattctctggctccaattctgggaacacagccactctgaccatcaccgggacccaggctgtagatgaggctgactattactgtcaggcgtgggacagcagcactgaggtgttcggcggaggaccaagctgaccgtcctacgtcagcccaaggctcgccccctc

SEQ ID NO: 557983 - DNA, 493 bp, Homo sapiens; identical to SEQ ID NO: 540127
  misc_feature: HIJSMM301BP943.10.17.B06.1.454.light.4.raw

SEQ ID NO: 557984 - DNA, 511 bp, Homo sapiens
  misc_feature: HIJSMM301DUOV9.9.25.C03.1.454.light.4.raw
tgatacgtctcacgaccggtgctcgatttagtagtgtagatttgggtttggggctgggcctaaggaagcagcactggtggtgcctcagccatggcctggaccgttctcctcctcggcctcctctctcactgcacagtctttgtagactctgtgaccttccatgtgctgactcagccaccctcggtgtcagtggcccctggaaagacggccagcataacctgtgagggagacaacattaaaacaaataatgtgcattggtaccagcagaagccaggccaggcccctgtcctggtcgtctttgatgatagtgaccggccctcagggatccctgagcgattctctggctccaactctgggaacacggccaccctgaccatcagcggggtcgaagccggggatgaggccgactatttctgtcagctgtgggattctcatgatggtagtgggggaatcttcggcggagggaccaggctgaccgtcctaagtcagccaaggctgcccctcggtcact

SEQ ID NO: 557985 - DNA, 486 bp, Homo sapiens; identical to SEQ ID NO: 535043
  misc_feature: HIJSMM301DWD2D.46.35.D02.1.454.light.4.raw

SEQ ID NO: 557986 - DNA, 488 bp, Homo sapiens; identical to SEQ ID NO: 535990
  misc_feature: HIJSMM301AM6HG.11.28.C06.1.454.light.4.raw

SEQ ID NO: 557987 - DNA, 501 bp, Homo sapiens; identical to SEQ ID NO: 535746
  misc_feature: HIJSMM301B8JUD.18.11.A11.1.454.light.4.raw

SEQ ID NO: 557988 - DNA, 511 bp, Homo sapiens
  misc_feature: HIJSMM301BH7P2.13.38.D05.1.454.light.4.raw
tcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagtattttaccctcaccatcaggggtctacagcctgaagattttgcgacttactattgtcaacagagttaccttctcccccggacgttcgccgaacggaccgaacggtaggaatacaagacgaactgtggcgtgcaccactctcgtcttctatcttcccgt

SEQ ID NO: 557989 - DNA, 494 bp, Homo sapiens; identical to SEQ ID NO: 535276
  misc_feature: HIJSMM301ARJ3G.16.6.A06.1.454.light.4.raw

SEQ ID NO: 557990 - DNA, 480 bp, Homo sapiens; identical to SEQ ID NO: 535630
  misc_feature: HIJSMM301COJLJ.40.59.F04.1.454.light.4.raw

SEQ ID NO: 557991 - DNA, 510 bp, Homo sapiens
  misc_feature: HIJSMM301AFKCP.43.23.C01.1.454.light.4.raw
tgtgagtagtcacgaccggtgctcgatttagtacacgtgattagggattgggaacctatgaacattctgtaggggccactgtcttctccacggtgctcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcggggcaaagctgccctgacactgtcaggtgtgcagcctgaggacgaggctgactattactgcctgctcatatatggtggcgcgtgggtgttcggcggaggaccaagctgaccgtcctgggtcagaccccg

SEQ ID NO: 557992 - DNA, 484 bp, Homo sapiens; identical to SEQ ID NO: 535240
  misc_feature: HIJSMM301AXUVH.47.60.F05.1.454.light.4.raw

SEQ ID NO: 557993 - DNA, 462 bp, Homo sapiens; identical to SEQ ID NO: 549716
  misc_feature: HIJSMM301B4NJA.11.73.G07.1.454.light.4.raw

SEQ ID NO: 557994 - DNA, 514 bp, Homo sapiens
  misc_feature: HIJSMM301CSN18.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctactgactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtgttcggcggagggaccaagctggccgtcctaggtcagcccaaggctgccccctcggtcactttgttcccaccctcctcgagtagtaca

SEQ ID NO: 557995 - DNA, 512 bp, Homo sapiens
  misc_feature: HIJSMM301ES2VC.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctggtcactctgttcccgccctcct

SEQ ID NO: 557996 - DNA, 486 bp, Homo sapiens
  misc_feature: HIJSMM301C1ADX.48.25.C03.1.454.light.4.raw
  modified_base (484)..(484): a, c, t, g, unknown or other
agtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggctcctcatttatgatacatccaccagggccactggtgtcccagccaggttcactggcggtgggtctgggacagagttcactctcaccatcagcagcctgcagtctgaagtattttactattttattactgtcagcagtatcgtaagtggactccgacgtttggccaagggaccaaggtggaagtcaaacgactgtgctgcacntc

SEQ ID NO: 557997 - DNA, 377 bp, Homo sapiens
  misc_feature: HIJSMM301DTITA.49.42.D09.1.454.light.4.raw
agtcgagagacacgaccggtgctcgatttagacacatacgcagggaaagggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtcgttataactttgtctcctggtaccagcaacacccaggcaacttcgcttttgtcttcggaactgggaccgaggtcaccgtcctgggtcagcccaaggccaaccccactgtcactctgttcccaccctcctctctctcgact

SEQ ID NO: 557998 - DNA, 464 bp, Homo sapiens
  misc_feature: HIJSMM301ERY6A.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgagactgactattactgccagtcctatgacatagaggctgaggtggttcggtatggtcgttcgggactcgtgggaccaacggtcaccggtcctaagtccaaggcccaaggcccaacccgtctcgtcactcctcgttcccaccctcctccatactcgta

SEQ ID NO: 557999 - DNA, 483 bp, Homo sapiens
  misc_feature: HIJSMM301ELA0C.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaagtggagatcaaacgaa

SEQ ID NO: 558000 - DNA, 496 bp, Homo sapiens; identical to SEQ ID NO: 537513
  misc_feature: HIJSMM301BCX4C.12.87.H10.1.454.light.4.raw

SEQ ID NO: 558001 - DNA, 504 bp, Homo sapiens; identical to SEQ ID NO: 545659
  misc_feature: HIJSMM301DTMFV.7.71.G05.1.454.light.4.raw

SEQ ID NO: 558002 - DNA, 519 bp, Homo sapiens
  misc_feature: HIJSMM301B1A6M.8.87.H10.1.454.light.4.raw
ctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagtgtcagtggccctgggacagacggccagaattacctgtggaggagtcaacattgggacttcagatgtgcactggtaccagcagaagccaggccaggcccctgtactggtcatctttagcgattccaaccggccctctgggatccctgagcgattctctggctccaagtcggggaacacggccaccctgaccatcagcagggcccaacccttggatgagggtgactatttctgtcaagtgtgggacaccaacacttgtgtcttcgggactgggaccgaggtcaccgtcctaagtcagcccagggccaaccccactgtcactctgttcccgccctcctcgacaccg

SEQ ID NO: 558003 - DNA, 487 bp, Homo sapiens
  misc_feature: HIJSMM301ESMIF.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtgggtcccatctaggttcagtggcagtggatctgggacagatttcactctcaccatcagcagtctgcaacctgaagattttgcaacttactactgtcaacagagttacggtaccccgtacacttttggccaggggaccaaactggacatcaaacgaactgtggctgcaccatctgtt

SEQ ID NO: 558004 - DNA, 489 bp, Homo sapiens
  misc_feature: HIJSMM301BK522.11.12.B01.1.454.light.4.raw
cgagagataccacgaccggtgctcgatttagtagtgtagattccgcggggctgggcctcaggaggcaacatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccccctgtcctactcatctttcaaaataccaggcggccctctggggtccctgagcgattctccggctccggctctgggaacacagtcactctgaccatcagcgggacccaggctattgatgaggctgtctacttctgtcaggcgtgggacaacagcgtggtgttcggcggagggaccagtctgaccgtcttaggtcagcccaaggctgccccctcggtcact

SEQ ID NO: 558005 - DNA, 482 bp, Homo sapiens
  misc_feature: HIJSMM301ATSGB.5.39.D06.1.454.light.4.raw
atcagacacgcacgaccggtgctcgatttagtgacatctcgcagttctttggggaggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccaggagaggccccaaagctccttatttatgatgcctccactttgattagtggggtcccaccaacgttcagcggcagtggatctgggacagagttcactctcaccatcagcagcctgcagcctgatgatcttggaacttattactgccaacaatataatagttattggacgttcggccaggggaccaaggtcgaaatgagacgaactgtggctgcatc

SEQ ID NO: 558006 - DNA, 503 bp, Homo sapiens; identical to SEQ ID NO: 541454
  misc_feature: HIJSMM301BUJWZ.9.12.B01.1.454.light.4.raw

SEQ ID NO: 558007 - DNA, 486 bp, Homo sapiens; identical to SEQ ID NO: 535385
  misc_feature: HIJSMM301DS4VO.19.71.G05.1.454.light.4.raw

SEQ ID NO: 558008 - DNA, 482 bp, Homo sapiens
  misc_feature: HIJSMM301AWJUB.46.26.C04.1.454.light.4.raw
actagcagtacacgaccggtgctcgatttagtctagcgactttgggtttgggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggaggaccaaggtggagatcaaacgaa

SEQ ID NO: 558009 - DNA, 502 bp, Homo sapiens
  misc_feature: HIJSMM301C3OJ5.9.57.F02.1.454.light.4.raw
tgatacgtctcacgaccggtgctcgatttagctcgatatagttgggtttgggggctctgcttcagctgtgggcacaagaggcagcactcaggacaatctccagcatggcctggtctcctctcctcctcactctcctcgctcactgcacagggtcctggggccagtctgtcctgacgcagccggcctcagtatctgggtccccagggcagagggtcaccatctcctgcactgcgaacagctccgacgtcgcgacaccttatattgtacactggtatcaagtacttccagggacagcccccagactcctcatctattctaacaccttccgaccctcaggggttcctgaccgattctctggctcccagtctggcacctcagcctccctggccgtcactgggctccagtctgaggatgaggctgattattactgccagtcctacgacactttcctgagtctttgggtgttcggcggagggaccaagctgaccgtccttcgtctacg

SEQ ID NO: 558010 - DNA, 505 bp, Homo sapiens
  misc_feature: HIJSMM301C3FD0.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacggggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcggagggaccaagctgaccgtcctgggtcagcccaaggctgccccctcggtcact

SEQ ID NO: 558011 - DNA, 497 bp, Homo sapiens
  misc_feature: HIJSMM301DKNE7.51.83.H06.1.454.light.4.raw
cgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaagagccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacagacttcgctctcaccatcagcagcctagagcctgaagattttgcagtttattattgtcagcagcgaaacaactggcctccttggacgttcggccaagggaccaaggtggaaatcaaacgaactagtggctgcaccatctgtcttcatt

SEQ ID NO: 558012 - DNA, 499 bp, Homo sapiens
  misc_feature: HIJSMM301DH0RX.14.59.F04.1.454.light.4.raw
cgtctagtaccacgaccggtgctcgatttagtacacacacttagggattgggggatcaggactcctcagttcaccttctcacaatgaggctccctgctcagctcctggggctgctaatgctctgggtctctggatccagtggggatattgtgatgactcagtctccactttccctgaccgtcacccctggagagccggcctccatctcctgcaggtctagtcagagcctcctgcatactaatggaaacaactttttggattggtacctgcagaagccagggcagtctccacagctcctgatctatttgggttctaatcgggcctccggagtccctgacaggttcagtggcagtggatcaggcacagattttacactgaaaatcagcagagtggaggctgaggatgttggggtttattactgcatgcaagctctacaaactcgaacgttcgccaagggaccaaggtggaaatcaaacgaactgtggctgcaccatctgtt

SEQ ID NO: 558013 - DNA, 500 bp, Homo sapiens
  misc_feature: HIJSMM301BBJTG.49.62.F07.1.454.light.4.raw
agtcgagagacacgaccggtgctcgatttagtagtcgcataaagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcactctcg

SEQ ID NO: 558014 - DNA, 521 bp, Homo sapiens; identical to SEQ ID NO: 539470
  misc_feature: HIJSMM301B4H7D.27.23.C01.1.454.light.4.raw

SEQ ID NO: 558015 - DNA, 498 bp, Homo sapiens; identical to SEQ ID NO: 536879
  misc_feature: HIJSMM301AUL6H.22.14.B03.1.454.light.4.raw

SEQ ID NO: 558016 - DNA, 492 bp, Homo sapiens; identical to SEQ ID NO: 537395
  misc_feature: HIJSMM301E081C.16.73.G07.1.454.light.4.raw

SEQ ID NO: 558017 - DNA, 483 bp, Homo sapiens
  misc_feature: HIJSMM301BOOHM.3.88.H11.1.454.light.4.raw
agacgcactccacgaccggtgctcgatttagcgacagcgagaacacacaaaggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccactttgcaaactgggtcccatccaggttcagcggcaggggatctgggacagatttcactctcaccatcagcagcctgcagcctgaagattttgcaacttactattgtcaacaggctaacagtttccctttaatcttcggccaagggacacgactggagattaaacgaactgtggctgcacca

SEQ ID NO: 558018 - DNA, 494 bp, Homo sapiens; identical to SEQ ID NO: 534994
  misc_feature: HIJSMM301ATBOX.27.78.H01.1.454.light.4.raw

SEQ ID NO: 558019 - DNA, 489 bp, Homo sapiens; identical to SEQ ID NO: 535386
  misc_feature: HIJSMM301E3U0Y.12.51.E07.1.454.light.4.raw

SEQ ID NO: 558020 - DNA, 505 bp, Homo sapiens; identical to SEQ ID NO: 539292
  misc_feature: HIJSMM301BYO29.19.85.H08.1.454.light.4.raw

SEQ ID NO: 558021 - DNA, 485 bp, Homo sapiens
  misc_feature: HIJSMM301CSWIM.51.52.E08.1.454.light.4.raw
  modified_base (431)..(431): a, c, t, g, unknown or other
  modified_base (464)..(464): a, c, t, g, unknown or other
cgatcgtatacacgaccggtgctcgatttagtcgagctctcagagagaaagggggtaggctcaggaggcagagctctgattgtctcaccatggcctggatccctctcctgcctccccctcctcattctctgcacagtctctgtggcctcctatgagctgacacagccatactcagtgtcagtgtctccgggacagacagccaggatcacctgctcaggagatgtactagggaaaaaatatgctcgttggttccagcagaaggcgggccaggcccctgtcttgatgatttataaagacactgagcggccctcagggatccctgagcgattctccggctccagctcagggactacagtcaccttgaccatcagcgggcccaggttgacgatgaggctgactattactgttactctgcggctgacaacaattcngggatattcggcggagggaccaagctgaccgtnttaggtcagcccaaggctccg

SEQ ID NO: 558022 - DNA, 497 bp, Homo sapiens; identical to SEQ ID NO: 535664
  misc_feature: HIJSMM301ANYFH.22.14.B03.1.454.light.4.raw

SEQ ID NO: 558023 - DNA, 507 bp, Homo sapiens
  misc_feature: HIJSMM301C6PQ0.13.4.A04.1.454.light.4.raw
tcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggccctgctgctgctgggtctggccatggtcgcccatggcctgctgcgcccaatggttgcaccgcaaagcggggacccagaccctggagcctcagttggaagcagccgatccagcctgcggagcctgtgggcaggtcagcccaaggccaacccactgtcactctgtt

SEQ ID NO: 558024 - DNA, 485 bp, Homo sapiens; identical to SEQ ID NO: 546918
  misc_feature: HIJSMM301DXVK2.51.3.A03.1.454.light.4.raw

SEQ ID NO: 558025 - DNA, 499 bp, Homo sapiens
  misc_feature: HIJSMM301DO2KG.48.68.G02.1.454.light.4.raw
agtatacatacacgaccggtgctcgatttagtcgatagtgaagggaaaggggatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagactttttagttacgtcggaccttcggccaagggacacgactggagattaaacgaactgtggctgcaccatctgtcttcatcttcccgcc

SEQ ID NO: 558026 - DNA, 516 bp, Homo sapiens
  misc_feature: HIJSMM301EHCA4.41.25.C03.1.454.light.4.raw
tctatactatcacgaccggtgctcgatttagtagtgtagatttgggtttgggggatagctcaggaagcagagcctggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctggggtccctttcggttttctggctccatcgacagtccctccaactccgcctcccttaccatatctgggctgaagagtgaggacgaggctgactacttctgtcagtcttatgatataaacaattatgtgataattggcggagggaccagggtgaccgtcctaggtcagcccaaggctgccccctcggtcactctgttccc

SEQ ID NO: 558027 - DNA, 502 bp, Homo sapiens
  misc_feature: HIJSMM301BXG08.40.59.F04.1.454.light.4.raw
tctagcgactcacgaccggtgctcgatttagtacacacacttagggattggggggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtcttagcaactacttagtctggtaccaacagaaacctggccaggctcccaggctcctcatctatgatgcatccagcagggccactggcatcccagccaggttcagtggcagtgggtctgggacagacttcactctcaccatcagcggcctagagcctgaagactttgcagtttattactgtcagcagcgtaccaactggccgctcactttcggcggagggaccaaggtggagatcaaacgaactgtggctgcaccatctgtcttcatcttccccg

SEQ ID NO: 558028 - DNA, 486 bp, Homo sapiens
  misc_feature: HIJSMM301CZSRD.10.23.C01.1.454.light.4.raw
catagtagtgcacgaccggtgctcgatttagtacacgtgattagggattggggtccaaacagagcttcagcaagcatagtgggaatctgcaccatgccctgggctctgctcctcctgaccctcctcactcactctgcagtgtcagtggtccaggcaggactgactcagccaccctcggtgtccaagggcttgagacagaccgccacactcacctgcactgggaacaccaacaatgtcggcaacgaaggagcagcttggctgcagcagcaccagggccaccctcccaaactcctatcctacaggaataacaaccggccctcagggatctcagagagattctcttcattcaggtcaggaaacacagcctccctgaccattactggactccagcctgagacgaggctgactattactgctcagcatgggacatcagcctcagtggttgggtgttcggcggagggaccaagctgaccgtcctaggtcacg

SEQ ID NO: 558029 - DNA, 481 bp, Homo sapiens
  misc_feature: HIJSMM301CS277.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtgggtcccatcaaggttcagtggcagtggatctgggacagatttcactctcaccatcaacagtctgcaacctgaagattttgcaacttactactgtcaacagagtttcactacccctctcactttcggcgggggaccgaaggtggagatcaaacgaactgtggctgcacc

SEQ ID NO: 558030 - DNA, 447 bp, Homo sapiens; identical to SEQ ID NO: 535882
  misc_feature: HIJSMM301CTXHF.18.9.A09.1.454.light.4.raw
  modified_base (429)..(429): a, c, t, g, unknown or other

SEQ ID NO: 558031 - DNA, 518 bp, Homo sapiens
  misc_feature: HIJSMM301DUHDZ.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaaagcggggacccagaccctggagcctcagttggaagcagccgatccagcctgcggagcctgtgggcaggtcagcccaaggctgccccctcggtcactctgttcccgccctcctccacg

SEQ ID NO: 558032 - DNA, 513 bp, Homo sapiens
  misc_feature: HIJSMM301BFBKE.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctactgactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtgttcggcggagggaccaagctggccgtcctaggtcagcccaaggctgccccctggtcactctgttcccgccctcctcgagtagtaca

SEQ ID NO: 558033 - DNA, 486 bp, Homo sapiens; identical to SEQ ID NO: 535523
  misc_feature: HIJSMM301C6NRJ.22.73.G07.1.454.light.4.raw

SEQ ID NO: 558034 - DNA, 489 bp, Homo sapiens
  misc_feature: HIJSMM301AI382.8.12.B01.1.454.light.4.raw
ctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactggtcatctatcaagataacaagcggccctcagggatccctgagcgattctctggctccaactctgggaacacagccactctgaccatcagcgggacccaggctacggatgaggctgactattactgtcaggcgtgggacagcagcacctatgtggttttcggcggagggaccaagctgaccgtccttggtcagcccaaggctgtccccccg

SEQ ID NO: 558035 - DNA, 504 bp, Homo sapiens
  misc_feature: HIJSMM301CBZTI.21.22.B11.1.454.light.4.raw
  modified_base (414)..(414): a, c, t, g, unknown or other
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattacngtgcatcacgggacgcaacatgggatgacaatctgagcggttgggtgttcggcggagggaccaaactgaccgtcctagggtcaggcccaa

SEQ ID NO: 558036 - DNA, 503 bp, Homo sapiens
  misc_feature: HIJSMM301AKE3B.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaacccca

SEQ ID NO: 558037 - DNA, 492 bp, Homo sapiens; identical to SEQ ID NO: 536901
  misc_feature: HIJSMM301D3PB1.9.34.D01.1.454.light.4.raw

SEQ ID NO: 558038 - DNA, 498 bp, Homo sapiens; identical to SEQ ID NO: 547576
  misc_feature: HIJSMM301BNW83.12.37.D04.1.454.light.4.raw

SEQ ID NO: 558039 - DNA, 493 bp, Homo sapiens
  misc_feature: HIJSMM301DSRTQ.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacagactggagattaaacgaactgtggctgcaccatctgtctt

SEQ ID NO: 558040 - DNA, 500 bp, Homo sapiens
  misc_feature: HIJSMM301BBENX.12.48.E04.1.454.light.4.raw
atacgacgtacacgaccggtgctcgatttagagagcgtcacagagagaaggggagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatttcttgttctggaacccactccaacatcggatataattctgtagactggtaccagcagcttccaggagcggccccccgactcctcatctttaataacaatcagcggccctcaggggtccctgaccgattctctggctccaagtctggcacctcagcctccctggccatcagtgggctccagtctgaggatgaggctgattattactgtgcatcatgggctgaccaccctgactgggtccggagtgttcggcggagggaccaagctgaccgtcctaggtcagccc

SEQ ID NO: 558041 - DNA, 497 bp, Homo sapiens
  misc_feature: HIJSMM301CRXI6.41.3.A03.1.454.light.4.raw
tctatactatcacgaccggtgctcgatttagagagcgtcacaggggagagctgctcagttaggacccagagggaaccatggaaaccccagcgcagcttctcttcctcctgctactctggctcccaggtgccaccggagaaattgtgttgacgcagtctccaggcaccctgtctttctctccaggggaaagagccaccctctcctgcagggccagtcagagtgttgacaaccagtacttcgcctggtaccagcagaacctggccaggctcccaggctcctcatggatggtgcatccagcagggccactggcatcccagacaggttcggtggcagtgggtctgggacagacttcactctcaccatcagcagcctggagcctgaagattttgtagtgtattactgtcagcagtatcttacaacaccggggagttttggccaggggaccaagctggagatcaaacgaactgtggctgcaccatctgtcttcatcttccccg

SEQ ID NO: 558042 - DNA, 520 bp, Homo sapiens; identical to SEQ ID NO: 537173
  misc_feature: HIJSMM301CZK8N.27.23.C01.1.454.light.4.raw

SEQ ID NO: 558043 - DNA, 500 bp, Homo sapiens
  misc_feature: HIJSMM301BMCAA.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttattctgtcagcagtctgaagactggccgttcactttcggcggagggaccaaggtggacctcaaacgaactgtgctgcaccatctgtcttcatctccgc

SEQ ID NO: 558044 - DNA, 491 bp, Homo sapiens; identical to SEQ ID NO: 535294
  misc_feature: HIJSMM301BJDML.16.68.G02.1.454.light.4.raw

SEQ ID NO: 558045 - DNA, 500 bp, Homo sapiens; identical to SEQ ID NO: 536183
  misc_feature: HIJSMM301DCK1X.10.17.B06.1.454.light.4.raw

SEQ ID NO: 558046 - DNA, 485 bp, Homo sapiens; identical to SEQ ID NO: 536040
  misc_feature: HIJSMM301DCHDR.15.1.A01.1.454.light.4.raw

SEQ ID NO: 558047 - DNA, 487 bp, Homo sapiens
  misc_feature: HIJSMM301B8RWO.4.26.C04.1.454.light.4.raw
agcactgtagcacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaaggtggagatcaaacgtaacg

SEQ ID NO: 558048 - DNA, 470 bp, Homo sapiens
  misc_feature: HIJSMM301ADDKR.43.30.C08.1.454.light.4.raw
  modified_base (442)..(442): a, c, t, g, unknown or other
tgtgagtagtcacgaccggtgctcgatttagtctgacgtcaaagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcgacgtcgtccgnggacgacgtggagtgtcagacgactagt

SEQ ID NO: 558049 - DNA, 510 bp, Homo sapiens
  misc_feature: HIJSMM301CYT0D.49.23.C01.1.454.light.4.raw
agtcgagagacacgaccggtgctcgatttagtacacgtgattagggattgggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgccaaagatatgcttattggtaccatcagaagtcaggccaggcccctgtactggtcatctatgaggacaccaaacgaccctccgggatccctacgagattctctggctccagtttagggacagtggccaccctgacagtcagtggggcccaggtggaggatgagggtgattactactgttactcaacagacattactactactcatagggtgttcggcggagggaccaagctgaccgtcctaggtcagcccaaggctgccccctcggtcactctgttcccaccct

SEQ ID NO: 558050 - DNA, 447 bp, Homo sapiens; identical to SEQ ID NO: 535201
  misc_feature: HIJSMM301A0EIN.18.9.A09.1.454.light.4.raw

SEQ ID NO: 558051 - DNA, 484 bp, Homo sapiens; identical to SEQ ID NO: 535400
  misc_feature: HIJSMM301B30TZ.46.26.C04.1.454.light.4.raw

SEQ ID NO: 558052 - DNA, 482 bp, Homo sapiens
  misc_feature: HIJSMM301D38A3.49.81.H04.1.454.light.4.raw
agtcgagagacacgaccggtgctcgatttagtagtgtagattcgcgggggcaggagtcagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatctaccactcactttcggcggagggaccacggtggagatcaaacgaactgtggctgcacc

SEQ ID NO: 558053 - DNA, 475 bp, Homo sapiens
  misc_feature: HIJSMM301BTT77.48.35.D02.1.454.light.4.raw
agtatacatacacgaccggtgctcgatttagcacacgatagttgggtttgggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattccctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtca

SEQ ID NO: 558054 - DNA, 489 bp, Homo sapiens; identical to SEQ ID NO: 540424
  misc_feature: HIJSMM301AEZCC.17.25.C03.1.454.light.4.raw

SEQ ID NO: 558055 - DNA, 488 bp, Homo sapiens
  misc_feature: HIJSMM301BJ6VZ.43.33.C11.1.454.light.4.raw
tgtgagtagtcacgaccggtgctcgatttagagtgagctcgttgggtttggggaagagctgctcagttaggacccagagggaaccatggaaaccccagcgcagcttctcttcctcctgctactctggctcccagataccaccggagaaattgtgttgacacagtctccaggcaccctgtctttgtctccaggggacagaggcaccctctcctgcagggccagtcagactgttagcagcagcagcttagcctggtaccagcagaaacctggccaggctcccaggctcctcatctatggtacatccaacagggccactggcataccagacaggttcagtggcagcgggtctgggacagacttcactctcaccatcagcagactggagcctgaagattttgcagtgtattactgtcagcagtatggtagctcacaggggacgttcggccaagggaccaaggtggaaatcaaacgaactgtggctgcaccat

SEQ ID NO: 558056 - DNA, 495 bp, Homo sapiens; identical to SEQ ID NO: 542571
  misc_feature: HIJSMM301BS1N3.7.59.F04.1.454.light.4.raw

SEQ ID NO: 558057 - DNA, 502 bp, Homo sapiens
  misc_feature: HIJSMM301A3TBG.10.71.G05.1.454.light.4.raw
catagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccaaaatagaggtcaacgaactagtggctgcaccatctgtcttcatt

SEQ ID NO: 558058 - DNA, 482 bp, Homo sapiens; identical to SEQ ID NO: 550464
  misc_feature: HIJSMM301D0EHM.13.50.E06.1.454.light.4.raw

SEQ ID NO: 558059 - DNA, 495 bp, Homo sapiens
  misc_feature: HIJSMM301CA7W6.41.33.C11.1.454.light.4.raw
tctatactatcacgaccggtgctcgatttagagtgagctcgttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggagggaccaagctgaccgtcctaggtcagcccaa

SEQ ID NO: 558060 - DNA, 495 bp, Homo sapiens; identical to SEQ ID NO: 541651
  misc_feature: HIJSMM301DROF3.16.78.H01.1.454.light.4.raw

SEQ ID NO: 558061 - DNA, 487 bp, Homo sapiens; identical to SEQ ID NO: 537079
  misc_feature: HIJSMM301CTYKE.14.55.E11.1.454.light.4.raw

SEQ ID NO: 558062 - DNA, 501 bp, Homo sapiens
  misc_feature: HIJSMM301AW15T.48.33.C11.1.454.light.4.raw
agtatacatacacgaccggtgctcgatttagagtgagctcgttgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaatatgcttattggtaccagcagaagtcaggccaggcccctgtgctggtcatctttgaggacaacaaacgaccctccgggatccctgagagattctctggctccagctcagggacaatggccaccttgactatcaatgggcccaggtggacgatgaggctgactactactgttcctcaacagacagtagtggtgatcgagggctgttcggcggagggaccaagctgaccgtcctaagtcagcccaaggctgccccctcggtcactctcg

SEQ ID NO: 558063 - DNA, 494 bp, Homo sapiens; identical to SEQ ID NO: 538747
  misc_feature: HIJSMM301AH049.22.86.H09.1.454.light.4.raw

SEQ ID NO: 558064 - DNA, 499 bp, Homo sapiens
  misc_feature: HIJSMM301AGA2Q.17.27.C05.1.454.light.4.raw
cgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtcatttatggtaagaataaccggccctcagggatcccagaccgattctctggctccgactcaggaaagacagcttccctgaccatcactgggctcaggcggaagatgaggctgactattactgtaactcccgggacagcagtgctgaccaggtggtattcggcggagggacccacctgaccgtcttaggtcagccaaggctgccccctcggtca

SEQ ID NO: 558065 - DNA, 495 bp, Homo sapiens
  misc_feature: HIJSMM301CU8MU.11.59.F04.1.454.light.4.raw
cgagagataccacgaccggtgctcgatttagtacacacacttagggattggggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagcccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctactcttttctcttcggaactgggaccacggtcaccgtcctaggtcagcccaaggccaacccactgtccactctgttcccaccctcctcgtatct

SEQ ID NO: 558066 - DNA, 518 bp, Homo sapiens
  misc_feature: HIJSMM301AR57W.10.38.D05.1.454.light.4.raw
catagtagtgcacgaccggtgctcgatttagtatctgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccacccaggcaaagcccccaaactccttgtttttgaggtcagtaagcggccctcaggagtccctgatcggttctctgcctccaagtctggcaacacggcctccctgaccgtctctgggctccaggctgaggatgaggctgattactactgcagcgcatattcaggccccaacagggtgtttggcggcgggactaaggtgaccgtcctgggtcagcccaaggctgccccctcggttactctgttcccgccctcct

SEQ ID NO: 558067 - DNA, 496 bp, Homo sapiens; identical to SEQ ID NO: 535109
  misc_feature: HIJSMM301AOL0A.16.78.H01.1.454.light.4.raw

SEQ ID NO: 558068 - DNA, 486 bp, Homo sapiens; identical to SEQ ID NO: 535385
  misc_feature: HIJSMM301EMOCK.19.71.G05.1.454.light.4.raw

SEQ ID NO: 558069 - DNA, 486 bp, Homo sapiens; identical to SEQ ID NO: 540241
  misc_feature: HIJSMM301CYSJX.46.26.C04.1.454.light.4.raw

SEQ ID NO: 558070 - DNA, 484 bp, Homo sapiens
  misc_feature: HIJSMM301C8KP1.4.57.F02.1.454.light.4.raw
agcactgtagcacgaccggtgctcgatttagctcgatatagttgggtttggggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtgggtcccatcaagattcagtggcagtggatctgggacagatttcactctcaccatcagtagtctacaacctgaagattttgcaacttactactgtcaacagagttacgatacccctccgctcactttcggcggagggaccaaggtggagatcaaacgaactgtgctgcacc

SEQ ID NO: 558071 - DNA, 486 bp, Homo sapiens; identical to SEQ ID NO: 535043
  misc_feature: HIJSMM301ATWWI.46.35.D02.1.454.light.4.raw

SEQ ID NO: 558072 - DNA, 512 bp, Homo sapiens
  misc_feature: HIJSMM301EAZSV.43.19.B08.1.454.light.4.raw
tgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatccggtcttcggcggagggaccaagttgaccgtcctaagtcagcccaaggctgccccctcggtcactctgttcccacctcctcta

SEQ ID NO: 558073 - DNA, 505 bp, Homo sapiens
  misc_feature: HIJSMM301ANGUQ.2.21.B10.1.454.light.4.raw
acgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtggtctgtggccttgggacagacagtcaggatcacatgccaaggagacagcctcagaacctattatgcaagttggtaccagcagaagccaggacaggcccctgtaattgtcatctatggaatctatggtaaaaacaaccggccctcagggatcccagaccgattctctggctcctactcaggaaacacagcttccttgaccatcactggggctcaggcggaagatgaggctgactattattgtaagtccggggacagaagtggtaattacatggtgttcggcggagggaccaagctgaccgtcctacgtcagcccaaggctgccccctcggtcact

SEQ ID NO: 558074 - DNA, 490 bp, Homo sapiens; identical to SEQ ID NO: 541974
  misc_feature: HIJSMM301AUHD1.22.65.F10.1.454.light.4.raw

SEQ ID NO: 558075 - DNA, 508 bp, Homo sapiens
  misc_feature: HIJSMM301CFY3W.17.33.C11.1.454.light.4.raw
cgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctctggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccg

SEQ ID NO: 558076 - DNA, 502 bp, Homo sapiens
  misc_feature: HIJSMM301CN32X.41.42.D09.1.454.light.4.raw
tctatactatcacgaccggtgctcgatttagacacatacgcagggaaagggggaggaactgctcagttaggacccagacggaaccatggaagccccagcgcagcttctcttcctcctgctactctggctcccagatgtcactggagaaatagtgatgacgcagtctccagccaccctgtctgtgtctccaggggaaagagccaccctctcctgcagggccagtcagagtcttagcggcaccttagcctggtaccagcagaaacctggccaggctcccaggctcctcatctatggtacatccaccagggtcactggtgttccagccaggttcagtggcagtgggtccgggacagagttcactctcaccatcagcagcctgcagtctgaagattttgcgatttattactgtcaccactataataattggccctccgcgtggacgttcggccaagggaccaaggtggaaatcaaacgaactagtggctgcaccatctgtcttcta

SEQ ID NO: 558077 - DNA, 486 bp, Homo sapiens; identical to SEQ ID NO: 535043
  misc_feature: HIJSMM301CPV6W.46.35.D02.1.454.light.4.raw

SEQ ID NO: 558078 - DNA, 479 bp, Homo sapiens; identical to SEQ ID NO: 535188
  misc_feature: HIJSMM301DOH9M.10.74.G08.1.454.light.4.raw

SEQ ID NO: 558079 - DNA, 457 bp, Homo sapiens; identical to SEQ ID NO: 542093
  misc_feature: HIJSMM301D0RO4.13.23.C01.1.454.light.4.raw

SEQ ID NO: 558080 - DNA, 496 bp, Homo sapiens
  misc_feature: HIJSMM301DDXEW.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgttggacgttcggccaagggaccaggtggaaatacaaacgaactagtggctgcaccatctgtcttcat

SEQ ID NO: 558081 - DNA, 493 bp, Homo sapiens
  misc_feature: HIJSMM301EPMEP.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctcactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaaactccttacacttttggccaggggaccaagctggagatcaaacgaactgtgg

SEQ ID NO: 558082 - DNA, 486 bp, Homo sapiens
  misc_feature: HIJSMM301D7UNA.17.26.C04.1.454.light.4.raw
cgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaagttggtatcagcagaaaccagggaaagcccctaagctcctgatctttgctgcatccagtttgcaaagtggggtcccttcaaggttcagtggcagtggatctgggacagatttcactctcaccatcagcagtctgcaacctgaagattttgcaacttactactgtcaacagagttacaatacccctcggctcactttcggcggagggaccaaggtggagatcaaacgaactgtggctgcacc

SEQ ID NO: 558083 - DNA, 502 bp, Homo sapiens; identical to SEQ ID NO: 547421
  misc_feature: HIJSMM301A09VL.51.5.A05.1.454.light.4.raw

SEQ ID NO: 558084 - DNA, 506 bp, Homo sapiens
  misc_feature: HIJSMM301CV2AJ.3.37.D04.1.454.light.4.raw
agacgcactccacgaccggtgctcgatttagtagcatactgttgggtttgggggggtctcaggaggcagcgctctcgggacgtctccaccatggcctgggctctgctattcctcaccctcctcactcagggcacagggtcctgggcccagtctgccctgagtcagcctgcctccgtgtctgggtctcctggacagtcgatcaccatctcctgcactggaaccagcagtgacgttggtagatataattatgtctcctggtaccaacaactcccaggcaaagcccccaaactgatgatttatgatgtcaataatcggccctcaggggtttctaatcgcttctctggctccaagtctggcaacacggcctccctgaccatctctgggctccagggtgaggacgaggctgattattactgcagctcatttacaagcagcaccactcaggtcttcggaactgggactaaggtcaccgtcctaggtcagcccaaggccaacccactgtcact

SEQ ID NO: 558085 - DNA, 494 bp, Homo sapiens
  misc_feature: HIJSMM301DBKVZ.52.54.E10.1.454.light.4.raw
cgcagtacgacacgaccggtgctcgatttagatcgtagcagaacacacaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagaacaccattggtacttatgtcttcggaactgcgaccaaggtcaccgtcctgggtcagcccaaggccaacccca

SEQ ID NO: 558086 - DNA, 493 bp, Homo sapiens; identical to SEQ ID NO: 549048
  misc_feature: HIJSMM301ANSNV.16.86.H09.1.454.light.4.raw

SEQ ID NO: 558087 - DNA, 473 bp, Homo sapiens
  misc_feature: HIJSMM301CL7AJ.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgttcccgccctcctcgacaccgcgactcgagcgggcggtcggcgacgacggccg

SEQ ID NO: 558088 - DNA, 488 bp, Homo sapiens; identical to SEQ ID NO: 544752
  misc_feature: HIJSMM301BGW4O.14.55.E11.1.454.light.4.raw

SEQ ID NO: 558089 - DNA, 446 bp, Homo sapiens; identical to SEQ ID NO: 536034
  misc_feature: HIJSMM301CZNSE.18.9.A09.1.454.light.4.raw

SEQ ID NO: 558090 - DNA, 508 bp, Homo sapiens
  misc_feature: HIJSMM301AEIIY.12.53.E09.1.454.light.4.raw
atacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaagctgaccgtcctgggtcagcccaaggctgccccctccggtcgactctgttcccaccctccctctacgtcgtat

SEQ ID NO: 558091 - DNA, 509 bp, Homo sapiens
  misc_feature: HIJSMM301B2HU8.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatcgtccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccggggccactttcggccctcgggaccaagtggatatcaaacgaactagtggctgcaccatctgtcttcta

SEQ ID NO: 558092 - DNA, 504 bp, Homo sapiens
  misc_feature: HIJSMM301DYMJC.4.59.F04.1.454.light.4.raw
agcactgtagcacgaccggtgctcgatttagtacacacacttagggattggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaactccactgtcact

SEQ ID NO: 558093 - DNA, 507 bp, Homo sapiens; identical to SEQ ID NO: 538313
  misc_feature: HIJSMM301BNO9M.7.71.G05.1.454.light.4.raw

SEQ ID NO: 558094 - DNA, 509 bp, Homo sapiens
  misc_feature: HIJSMM301BYDGW.21.87.H10.1.454.light.4.raw
tcgtcgctcgcacgaccggtgctcgatttagcagtactgcgttgggtttgggggggtcgacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacgttttaaccttgtctcctggtatcaacaacaccaggacaaagccccaaaactcttaatttctggcgtcaatcagcgaccctcacatgtttccagtcgattctctgcatccaagtctggcaacacggcctttctgacaatctctcaactccaggctgaagacgaggctatttattactgctcctcatacgcaggtggcacattttttcttggtttttggcggcggggacccagatgactgtcctcagtcagcccaaggctgccccctcggt

SEQ ID NO: 558095 - DNA, 488 bp, Homo sapiens
  misc_feature: HIJSMM301A91CZ.51.71.G05.1.454.light.4.raw
cgatcgtatacacgaccggtgctcgatttagtgtcgtcgcaagagagagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctggtcagcccaaggccaaccca

SEQ ID NO: 558096 - DNA, 484 bp, Homo sapiens; identical to SEQ ID NO: 535400
  misc_feature: HIJSMM301AQKYY.46.26.C04.1.454.light.4.raw

SEQ ID NO: 558097 - DNA, 492 bp, Homo sapiens
  misc_feature: HIJSMM301B5AEO.13.56.F01.1.454.light.4.raw
tcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccaggggaaagagccaccctctcctgcagggccagtcagacagttagcaacaacgtagcctggtaccagcagaaacgtggccaggctcccaggctcctcatctatggtgcatccaccagggccactggtatcccagaccggttcagtggcagtgggtctgggacagacttcactctcaccatcagcagtctgcagtctgagtatttgctagtttattactgtcagcagtataataactggcctcgtacatgtactacttttggccagggaccaacctggagatcagacgaa

SEQ ID NO: 558098 - DNA, 481 bp, Homo sapiens
  misc_feature: HIJSMM301B9PO5.41.35.D02.1.454.light.4.raw
tctatactatcacgaccggtgctcgatttagcacacgatagttgggtttggggctccaaacagagcttcagcaagcatagtgggaatctgcaccatgccctgggctctgctcctcctgaccctcctcactcactctgcagtgtcagtggtccaggcaggactgactcagccaccctcggtgtccaagggcttgagacagaccgccacactcacctgcactgggaacagctacaatgttggcaacgaaggagcagcttggctgcagcagtaccagggccaccctcccaaattgctatcatacaggaagaacaaccgcccctcggggatctccgagagattctctgcatcaacgtcaggaaacatagcctccctgaccattactggactccagcctgaggacgaggctgactattactgctcagcatgggacagcagcctcaatgtttgggtgttcggcggaggggaccaagctgaccgtcct

SEQ ID NO: 558099 - DNA, 503 bp, Homo sapiens; identical to SEQ ID NO: 539069
  misc_feature: HIJSMM301CWC74.48.26.C04.1.454.light.4.raw

SEQ ID NO: 558100 - DNA, 441 bp, Homo sapiens; identical to SEQ ID NO: 534971
  misc_feature: HIJSMM301C54C6.11.3.A03.1.454.light.4.raw

SEQ ID NO: 558101 - DNA, 509 bp, Homo sapiens
  misc_feature: HIJSMM301DBD3J.52.55.E11.1.454.light.4.raw
cgcagtacgacacgaccggtgctcgatttagcactcgcacgttgggtttggggctgggcctcaggaagcagcatcgggggtgccgcagccatggcctggaccgctctccttctgagcctccttgctcactttacagggtctgcggcctcccatgacctgactcagtcactctcagtgtcggtggccctgggacagacggccactattacctgtgggggatacaacattggaactaaaaatgtgcagtggtaccagcagaagccaggccaggcccctgtgttggtcatctatagggatcgaagacgggcctctgggattcctgagcgattctctggctccaactcggagaacacggccaccctgaccatcagaagtgcccaagtcggtgatgaggcagactattactgccaggtgtgggacagtggtgttgtgatattcggcggagggaccaagctgaccgtcctaagtcagcccaaggctgccccctggtcactctgttcccacctcct

SEQ ID NO: 558102 - DNA, 484 bp, Homo sapiens; identical to SEQ ID NO: 535240
  misc_feature: HIJSMM301BK76X.47.60.F05.1.454.light.4.raw

SEQ ID NO: 558103 - DNA, 501 bp, Homo sapiens
  misc_feature: HIJSMM301E1LBS.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctacggtcagcccaaggccaacccca

SEQ ID NO: 558104 - DNA, 483 bp, Homo sapiens; identical to SEQ ID NO: 535413
  misc_feature: HIJSMM301AOTQF.26.78.H01.1.454.light.4.raw

SEQ ID NO: 558105 - DNA, 504 bp, Homo sapiens
  misc_feature: HIJSMM301APPMU.48.35.D02.1.454.light.4.raw
agtatacatacacgaccggtgctcgatttagcacacgatagttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcaaaaacctggccaaactcccaggctcctcatctatggtgcatccaccagggccactggaatcccaaccaggttcagtggcagagggtctgggacggaattcactctcaccatcagcagtctgcagtctgaagattttgcagtttattattgtcagcagtataataattggcctccgggggtcactttcggccctgggaccaaaataaatagtcaatcgaactgtggctgcaccatctgtcttcatt

SEQ ID NO: 558106 - DNA, 416 bp, Homo sapiens; identical to SEQ ID NO: 539343
  misc_feature: HIJSMM301D3QZL.18.78.H01.1.454.light.4.raw

SEQ ID NO: 558107 - DNA, 506 bp, Homo sapiens
  misc_feature: HIJSMM301BRHSN.41.56.F01.1.454.light.4.raw
tctatactatcacgaccggtgctcgatttagcagacgtctgaacacacaaagggggggtcacaagaggcagcgctctcgggacgtctccaccatggcctgggctctgctgctcctcactctcctcactcaggacacagggtcctgggcccagtctgccctgactcagcctgactccgtgtctgggtctcctggacagtcgatcaccatctcctgcactggaaccaacagtgatgttgggaattataaccttgtctcctggtaccaacaccacccaggcaaagcccccaaactcataatttatgagggcagtaagcggccctcaggggtttctaatcgcttctctggctccaagtctggcaacacggcctccctgacaatctctggactccaggctgaggacgaggctgattattactgctgctcatatgcaggtagtagggattgggtgttcggcggagggaccaagctgaccgtcctgggtcagcccaaggctgccccctggtca

SEQ ID NO: 558108 - DNA, 505 bp, Homo sapiens; identical to SEQ ID NO: 536117
  misc_feature: HIJSMM301CCVZ1.8.71.G05.1.454.light.4.raw

SEQ ID NO: 558109 - DNA, 484 bp, Homo sapiens
  misc_feature: HIJSMM301CY0WM.3.10.A10.1.454.light.4.raw
agacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatcttatgtcttcggatctgggaccagggtcaccgtcctaggtcagcccaaggccaa

SEQ ID NO: 558110 - DNA, 502 bp, Homo sapiens
  misc_feature: HIJSMM301DUUV1.4.6.A06.1.454.light.4.raw
agcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtctggggcccccgggcagagggtcatcctctcttgttctggaggcagctccaacatcggaggacatcctgtgagctggtaccaacacctcccaggaacggcccccaaactcctcatctatacagattctaagaggcccgcaggggtcccagatcgattctctggctccaggtctggcacctcagcctccctgtccatcagtggactccggtctgaggatgaggctgactactattgttcaggatgggattacagcctacatgctcggctgttcggcggagggaccaaactgaccgtcttaggtcagcccaaggctgccccccg

SEQ ID NO: 558111 - DNA, 484 bp, Homo sapiens; identical to SEQ ID NO: 536162
  misc_feature: HIJSMM301BKQEE.13.59.F04.1.454.light.4.raw

SEQ ID NO: 558112 - DNA, 496 bp, Homo sapiens; identical to SEQ ID NO: 538394
  misc_feature: HIJSMM301A6Y5G.22.86.H09.1.454.light.4.raw

SEQ ID NO: 558113 - DNA, 498 bp, Homo sapiens
  misc_feature: HIJSMM301C2WYS.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgaactgtggctgcaccatctgtcttcatcttcccgcatctacata

SEQ ID NO: 558114 - DNA, 493 bp, Homo sapiens; identical to SEQ ID NO: 536769
  misc_feature: HIJSMM301CM0KK.19.83.H06.1.454.light.4.raw

SEQ ID NO: 558115 - DNA, 479 bp, Homo sapiens; identical to SEQ ID NO: 535586
  misc_feature: HIJSMM301AS7MF.13.34.D01.1.454.light.4.raw

SEQ ID NO: 558116 - DNA, 512 bp, Homo sapiens; identical to SEQ ID NO: 551521
  misc_feature: HIJSMM301BDTRB.48.87.H10.1.454.light.4.raw

SEQ ID NO: 558117 - DNA, 472 bp, Homo sapiens; identical to SEQ ID NO: 535898
  misc_feature: HIJSMM301A0JWR.15.8.A08.1.454.light.4.raw

SEQ ID NO: 558118 - DNA, 494 bp, Homo sapiens
  misc_feature: HIJSMM301EZC0O.8.81.H04.1.454.light.4.raw
ctcgcgtgtccacgaccggtgctcgatttagtagtgtagattcgcggggggagtcagacccagtcaggacacagcatggacatgagggtccccgctcagctcctggggctcctgctgctctggctcccaggtgccaactgtgacatccagatgacccagtcaccttccaccctgtctgcatctgtgggagacagagtcaccatcagttgccgggccagtcacagtattgacaatttgttggcctggtatcagcagaaaccaggaaaagccccgaacctcctgatctatcaggcgtctactttggaaagtggggtcccatcaaggttccgcggcagtggatctgggacagacttcactctcaccatcagcagcctgcagcctgatgattttgctacttattactgccaacagtatagtactttttctccggacacttttggccgggggaccaagctggagatcaaacgaactgtggctgcaccatctgtcttcta

SEQ ID NO: 558119 - DNA, 480 bp, Homo sapiens; identical to SEQ ID NO: 551245
  misc_feature: HIJSMM301EPYJI.21.25.C03.1.454.light.4.raw

SEQ ID NO: 558120 - DNA, 439 bp, Homo sapiens
  misc_feature: HIJSMM301CV25H.17.11.A11.1.454.light.4.raw
cgtagactagcacgaccggtgctcgatttagctacgactgcagggagagtggagactgagtcatcacaacatctccactctccctgcccgtcactcttggacagccggcctccatctcctgcaggtctagtgaaagcctcgtagacagtgatggaaacacctacttgaattggtttcaacagaggccaggccaatctccaaggcgcctaatttataaggtttctaaccgggactctggggtcccagacagattcagcggcagtgggtcaggcactgatttcacactgagaatcagcagggtggaggctgaggatgttggggtttattactgcttgcaaggtacacactggtacacttttggccaggggaccaagctggagatcaaacgaactgtggctgcaccatctgtcttcatcttccgccatctgactagtctacg

SEQ ID NO: 558121 - DNA, 492 bp, Homo sapiens
  misc_feature: HIJSMM301EW2LE.9.34.D01.1.454.light.4.raw
tgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacatcggggcacgttatgatgtacactggtaccaacaacttccaggaacagcccccaaagtcatcatttatgacaacatgaagcggccctcaggggtccctgaccgattctccggctccaagtctggcacatcagcctccctggccatcactgggctccaggctgaggatgaggctgactattactgccagtcgtatgacagtggcctaagtaacatcgtcttcggaactgggaccaaggtcaccgtcg

SEQ ID NO: 558122 - DNA, 493 bp, Homo sapiens; identical to SEQ ID NO: 537281
  misc_feature: HIJSMM301DMR8N.9.1.A01.1.454.light.4.raw

SEQ ID NO: 558123 - DNA, 506 bp, Homo sapiens; identical to SEQ ID NO: 534969
  misc_feature: HIJSMM301DS7OT.18.37.D04.1.454.light.4.raw

SEQ ID NO: 558124 - DNA, 504 bp, Homo sapiens
  misc_feature: HIJSMM301AL9ZF.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggccccaaaaattggtcatctatgaagacgacaaacgaccctccgggatccctgagagattctctggctccagctcagggactatggccaccttgactatcagtgggcccaagtggaggatgaagctgactactactgttactcaatagagaacagtgataatttctgggtgttcggcggagggaccaaactgaccgtcctaggtcagcccaaggctgccccctcggtcactctgtt

SEQ ID NO: 558125 - DNA, 479 bp, Homo sapiens; identical to SEQ ID NO: 554716
  misc_feature: HIJSMM301BPPQJ.41.34.D01.1.454.light.4.raw

SEQ ID NO: 558126 - DNA, 493 bp, Homo sapiens
  misc_feature: HIJSMM301CJWEE.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatctgtctcatcttccccg

SEQ ID NO: 558127 - DNA, 476 bp, Homo sapiens
  misc_feature: HIJSMM301CFU13.14.5.A05.1.454.light.4.raw
cgtctagtaccacgaccggtgctcgatttagatagatagacagggaaccatggaagccccagctcagcttctcttcctcctgctactctggctcccagataccaccggagaaattgtgttgacacagtctccaggcaccctgtccttgtctccaggggaaagagccaccctctcctgcagggccagtcagagtgttgatacgtacttagcctggtaccaacagaaacctggccaggctcccaggctcctcatctatgatgcatccatcagggccactggcatcccagccaggttcagtggcagtgggtctgggacagacttcactctcaccatcagcagcctagagcctgaagattttgcagtttattactgtcagcagcgtaccaactggcctcctgcgctcactttcggcggagggaccaaggtggagatcaaacgaactgtggctgcaccatctgtcttcatcttcccgccat

SEQ ID NO: 558128 - DNA, 515 bp, Homo sapiens
  misc_feature: HIJSMM301CQPAN.22.36.D03.1.454.light.4.raw
acatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaaccccccaactcatcatttatggtgtcactcgtcggccctcaggagtctctcatcgcttctcaggctccaagtctggcaacacggcctccctaaccatctctgggctccagtttgaggacgagtctacttattactgcagttcctttaaattaggcgccactctcgtggtttcggcggaggcaccgaagtgaccgtcctcggtcagcccaaggctcgccccctcggtcacttcc

SEQ ID NO: 558129 - DNA, 509 bp, Homo sapiens
  misc_feature: HIJSMM301DFDCP.48.9.A09.1.454.light.4.raw
agtatacatacacgaccggtgctcgatttagcgagacgcgcaggacacgaccggtgctcgatttagatagctctcgttgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgtaacg

SEQ ID NO: 558130 - DNA, 493 bp, Homo sapiens
  misc_feature: HIJSMM301ALDW8.5.48.E04.1.454.light.4.raw
atcagacacgcacgaccggtgctcgatttagagagcgtcacagagagaaggggctggagaagagctgctcagttaggacccagagggaaccatggaaaccccagcgcagcttctcttcctcctgctactctggctcccagattctgccggagaagttgtcttgacgcagtctccaggcaccctgtctttgtctccaggtgaaagcgccaccctctcctgccgggccagtgagagtcttagcggcgactacttagcctggtatcagcaaaaacctggccagtctcccaggctcctcatctctggtgtttccttcagggccactggcgtcccaggcagattcaggggcagtgggtctgggacagacttcactctcaccatcagcagactggagcctgaagactttgcgctgtatttctgtcagcagtatgttttcgcacctttcacttttcggcggagggaccaaggtggagagcagacgaactgtggctgcacc

SEQ ID NO: 558131 - DNA, 508 bp, Homo sapiens
  misc_feature: HIJSMM301DU0OF.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatatttcgtgctccgtacacttttggccaggggacccaggtggagatcagactgatattaacagcgaaaagagattttgttaagggaagtaatgaagttaa

SEQ ID NO: 558132 - DNA, 486 bp, Homo sapiens; identical to SEQ ID NO: 535043
  misc_feature: HIJSMM301BEA70.46.35.D02.1.454.light.4.raw

SEQ ID NO: 558133 - DNA, 508 bp, Homo sapiens
  misc_feature: HIJSMM301COQ72.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcggccaagggaccgaaggtggaaagtcaaaacgaactagtggctgcaccatctgtcttctatcttccccg

SEQ ID NO: 558134 - DNA, 497 bp, Homo sapiens
  misc_feature: HIJSMM301CC8IY.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgcagtttattactgtcagcagtataattactggcctcggacgttcggtccgaaggaccgaacggtggaaggtacaaacgaactagtggctgcaccatctgtctt

SEQ ID NO: 558135 - DNA, 481 bp, Homo sapiens; identical to SEQ ID NO: 535993
  misc_feature: HIJSMM301A38T2.21.25.C03.1.454.light.4.raw

SEQ ID NO: 558136 - DNA, 494 bp, Homo sapiens; identical to SEQ ID NO: 534994
  misc_feature: HIJSMM301AXGS9.27.78.H01.1.454.light.4.raw

SEQ ID NO: 558137 - DNA, 479 bp, Homo sapiens; identical to SEQ ID NO: 536050
  misc_feature: HIJSMM301DYAT6.5.73.G07.1.454.light.4.raw

SEQ ID NO: 558138 - DNA, 508 bp, Homo sapiens
  misc_feature: HIJSMM301CDLGG.13.5.A05.1.454.light.4.raw
tcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataggaactacttagcttggtaccaacagaaaccaggacagcctccgaagttactctttactgggcgtctacccgggaatccggggtccctgaccgattcagtggcagcgggtctgggacagatttcactctcaccatcagcagccttcaggctgaagatgtggcagtttattactgtcagcaatattatatctctcctcctcggacgttcggccaagggaccagggtggaaatacaaacgaactagtggctgcaccatctgtcttcta

SEQ ID NO: 558139 - DNA, 471 bp, Homo sapiens; identical to SEQ ID NO: 537461
  misc_feature: HIJSMM301C0HOC.7.81.H04.1.454.light.4.raw

SEQ ID NO: 558140 - DNA, 476 bp, Homo sapiens; identical to SEQ ID NO: 538026
  misc_feature: HIJSMM301BKWT1.13.76.G10.1.454.light.4.raw

SEQ ID NO: 558141 - DNA, 510 bp, Homo sapiens; identical to SEQ ID NO: 540140
  misc_feature: HIJSMM301DPEEM.5.27.C05.1.454.light.4.raw

SEQ ID NO: 558142 - DNA, 510 bp, Homo sapiens
  misc_feature: HIJSMM301C5YJF.43.67.G01.1.454.light.4.raw
tgtgagtagtcacgaccggtgctcgatttagagtatacatattgggtttgggggagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgttatactccgccgacgttcggtccggggaccgaccgtggaatacaaacgaaactgtggctgcaccatctgtctt

SEQ ID NO: 558143 - DNA, 478 bp, Homo sapiens
  misc_feature: HIJSMM301C0M9P.12.10.A10.1.454.light.4.raw
atacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggccagtcaggacattagcaattatttaggctggtatcagcagaagccagggaaagcccctaacgtcctgatctatggtgcatccactttgcatagtggggtcccatcaaggttcagcggcagtggatctgggacagaattcactctcacaatcaccagcctgcagcctgaagattttgcaacttattactgtcaacaggtttatatttacctcgtattttcggccctgggaccacagtagatatcaaacgaactgtggctgcacc

SEQ ID NO: 558144 - DNA, 460 bp, Homo sapiens; identical to SEQ ID NO: 536053
  misc_feature: HIJSMM301AM80K.22.28.C06.1.454.light.4.raw

SEQ ID NO: 558145 - DNA, 458 bp, Homo sapiens
  misc_feature: HIJSMM301A17QP.10.86.H09.1.454.light.4.raw
catagtagtgcacgaccggtgctcgatttagtgctatagacttgggtttgggggctgtcccggggaagtgctggtaccaggatacataattcgccctcagtgtctgcggccccaggacagagggtcaccgtctcctgctctggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccagaccggggacgaggccgattattactgcgcaacttgggactccaacctgactgttggggctttcggcggagggactaagttgaccgtcctacgtcagcccaaggctgcccctcggtcactctgttcccgccctcctccactactatg

SEQ ID NO: 558146 - DNA, 481 bp, Homo sapiens
  misc_feature: HIJSMM301A4Z82.48.5.A05.1.454.light.4.raw
agtatacatacacgaccggtgctcgatttagatagatagacagggggagtcagacccagtcaggacacagcatggacatgagggtccccgctcagctcctggggctcctgctgctctggctcccaggtgccaaatgtgacatccagatgacccaggctccttccaccctgtctgcatctgtaggagacagagtcaccatcacttgccgggccagtcagagtattgttagctggttggcctggtatcaacagagaccagggaaagcccctaaactcctgatctatacggcatctactttacagagtggggtcccgatcaaggttcagcggcagtgcatctgggacagaattcactctcaccatcagcagcctgcagcctgatgattttgcaacttattactgccaacagtattatacttatccatggacgttcggccaagggaccaacggtggaaatcaaacgaactagtggctgcaccact

SEQ ID NO: 558147 - DNA, 499 bp, Homo sapiens
  misc_feature: HIJSMM301EW5SQ.15.25.C03.1.454.light.4.raw
tctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggttctaatcgggcctccggggtccctgacaggttcagtggcagtggatcaggcatagattttacactgaaaatcagcagagtggaggctgaggacgttgggggtttattactgcatgcaaggtctacaaaccccgatcaccttcggccgagggacacgcctggagattaaacgaactgtggctgcaccat

SEQ ID NO: 558148 - DNA, 474 bp, Homo sapiens
  misc_feature: HIJSMM301B3JDS.3.12.B01.1.454.light.4.raw
agacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggctcccaggctcctcatctatgatgcatccaccagggccaccggtatcccagccaggttcagtggcagtgggtctgggacagagttcactctcaccatcagcagcctgcagtctgaggattttgcagtttattactgtcagcattacaataactggcctcggctcactttcggcggagggaccaaggtggagatcaaacgaactg

SEQ ID NO: 558149 - DNA, 513 bp, Homo sapiens; identical to SEQ ID NO: 536917
  misc_feature: HIJSMM301CKQ29.16.83.H06.1.454.light.4.raw

SEQ ID NO: 558150 - DNA, 488 bp, Homo sapiens; identical to SEQ ID NO: 537124
  misc_feature: HIJSMM301C9YNM.11.25.C03.1.454.light.4.raw

SEQ ID NO: 558151 - DNA, 495 bp, Homo sapiens
  misc_feature: HIJSMM301BLUT6.14.5.A05.1.454.light.4.raw
cgtctagtaccacgaccggtgctcgatttagatagatagacaggggggaactgctcagttaggacccagagggaaccatggaagccccagctcagcttctcttcctcctgctactctggctcccagataccaccggagaaattgtgttgacacagtctccaggcaccctgtccttgtctccaggggaaagagccaccctctcctgcagggccagtcagagtgttgatacgtacttagcctggtaccaacagaaacctggccaggctcccaggctcctcatctatgatgcatccatcagggccactggcatcccagccaggttcagtggcagtgggtctgggacagacttcactctcaccatcagcagcctagagcctgaagattttgcagtttattactgtcagcagcgtaccaactggcctcctgcgctcactttcggcggagggaccgaaggtggagatcaaacgaactgtggctgcaccactctgtcttcta

SEQ ID NO: 558152 - DNA, 495 bp, Homo sapiens
  misc_feature: HIJSMM301EF7BI.51.33.C11.1.454.light.4.raw
cgatcgtatacacgaccggtgctcgatttagagtgagctcgttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataatttggggtctaagtatgtttcgtggtatcaacatcacccaggccggtccccgatactgctcctctatcatgatgccaagcggccctcagggatccctgagcgattctctggctccaactctggggacacagccactctgaccatccgcgggacccaggctgtggatgaggctgactattactgtcaggcgtgggacagggaggctgcgattttcggcggagggaccagtctgaccgtcctaggtcagcccaaggctgcccctcggtcactc

SEQ ID NO: 558153 - DNA, 485 bp, Homo sapiens; identical to SEQ ID NO: 535822
  misc_feature: HIJSMM301BC7HX.14.53.E09.1.454.light.4.raw

SEQ ID NO: 558154 - DNA, 492 bp, Homo sapiens; identical to SEQ ID NO: 535126
  misc_feature: HIJSMM301BVG8N.18.11.A11.1.454.light.4.raw

SEQ ID NO: 558155 - DNA, 486 bp, Homo sapiens
  misc_feature: HIJSMM301B9OG5.5.55.E11.1.454.light.4.raw
atcagacacgcacgaccggtgctcgatttagcactcgcacgttgggtttgggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacaatttcaacagtaagaactacttagcttggtaccagcagaaaccaggacagcctcctaggctgctcatttactgggcatctacccgggaatccggggtccctgaccgattcagtggcagcggctctgggacagatttcactctcaccatcagcagcctgcaggctgaagatgtggcagtttatactgtcagcaatattttattactcctctgacgttcggccaagggccaaggtgaaatcaaacgactgtgg

SEQ ID NO: 558156 - DNA, 460 bp, Homo sapiens; identical to SEQ ID NO: 536053
  misc_feature: HIJSMM301ET74I.22.28.C06.1.454.light.4.raw

SEQ ID NO: 558157 - DNA, 504 bp, Homo sapiens; identical to SEQ ID NO: 539091
  misc_feature: HIJSMM301B9ALJ.8.28.C06.1.454.light.4.raw

SEQ ID NO: 558158 - DNA, 501 bp, Homo sapiens
  misc_feature: HIJSMM301A801M.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggtccgaacgggaccgaaacgtaggacgatcaagacgaactagtggcgtgcaccatctgtt

SEQ ID NO: 558159 - DNA, 494 bp, Homo sapiens; identical to SEQ ID NO: 537091
  misc_feature: HIJSMM301B6EOI.27.78.H01.1.454.light.4.raw
  modified_base (426)..(426): a, c, t, g, unknown or other

SEQ ID NO: 558160 - DNA, 490 bp, Homo sapiens
  misc_feature: HIJSMM301DNRFY.13.5.A05.1.454.light.4.raw
tcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctcgaggctcactttcggcggagggaccaaggtggagatcaaacgaactgtgg

SEQ ID NO: 558161 - DNA, 441 bp, Homo sapiens; identical to SEQ ID NO: 535074
  misc_feature: HIJSMM301EE7XL.11.3.A03.1.454.light.4.raw

SEQ ID NO: 558162 - DNA, 447 bp, Homo sapiens; identical to SEQ ID NO: 541921
  misc_feature: HIJSMM301A3A8N.18.9.A09.1.454.light.4.raw

SEQ ID NO: 558163 - DNA, 502 bp, Homo sapiens
  misc_feature: HIJSMM301E0LZY.2.76.G10.1.454.light.4.raw
acgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtccccgggcagagggtcaccatctcttgttctggaggcacctccaacatcgggcgtgataatgtgtactggtacaagcaggtcccaggaacgacccccaaactcctcatctctcacaataatcagcggccctcaggagtccctgaccgattctctgcctccaagtccggcacctcagcctccctggccatcagtgggctccgggccgaggatgaggctgattattactgtgcaggatgggatgacaacctgggtgcttatctcttcggacctgggaccaaggtcaccgtccttggt

SEQ ID NO: 558164 - DNA, 489 bp, Homo sapiens; identical to SEQ ID NO: 542780
  misc_feature: HIJSMM301CG3N4.16.53.E09.1.454.light.4.raw

SEQ ID NO: 558165 - DNA, 485 bp, Homo sapiens; identical to SEQ ID NO: 549954
  misc_feature: HIJSMM301DJRWH.4.2.A02.1.454.light.4.raw

SEQ ID NO: 558166 - DNA, 488 bp, Homo sapiens; identical to SEQ ID NO: 547744
  misc_feature: HIJSMM301DIHF4.17.57.F02.1.454.light.4.raw

SEQ ID NO: 558167 - DNA, 472 bp, Homo sapiens
  misc_feature: HIJSMM301AXPIX.51.11.A11.1.454.light.4.raw
cgatcgtatacacgaccggtgctcgatttagctacgactgcaggggagtcccaaccaggacacaacatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctcccactcactttcggcggagggaccaaggtggagatcaaacgaactgtggctgcaccat

SEQ ID NO: 558168 - DNA, 489 bp, Homo sapiens; identical to SEQ ID NO: 535139
  misc_feature: HIJSMM301DSF4U.14.55.E11.1.454.light.4.raw

SEQ ID NO: 558169 - DNA, 491 bp, Homo sapiens; identical to SEQ ID NO: 538238
  misc_feature: HIJSMM301ANZK9.26.78.H01.1.454.light.4.raw

SEQ ID NO: 558170 - DNA, 389 bp, Homo sapiens
  misc_feature: HIJSMM301AF1WI.21.40.D07.1.454.light.4.raw
tcgtcgctcgcacgaccggtgctcgatttagtgatagagcgtaacaacagagggtcaccatcccttgttctggaagcagctccaacatcggaagacattatgtgtactggtaccagcagctcccaggaacggcccccaaactcctcatctataggaataatcagcggccctcaggggtccctgaccgattctctggctccaattctggcacctcagcctccctggccatcagtgggctccggtccgaggatgaggctgattattactgtgcagcatgtgatgacggcctgagtggtccggtgttcggcggagggaccaggctgaccgtcctaggtcagcccaaggctgccccctcggtcactctgttcccgccctcctccgagcgacga

SEQ ID NO: 558171 - DNA, 477 bp, Homo sapiens; identical to SEQ ID NO: 537678
  misc_feature: HIJSMM301A9VRJ.12.1.A01.1.454.light.4.raw

SEQ ID NO: 558172 - DNA, 506 bp, Homo sapiens
  misc_feature: HIJSMM301BOD6V.43.3.A03.1.454.light.4.raw
tgtgagtagtcacgaccggtgctcgatttagagagcgtcacaggggggtagctcaggaagcagagcctggagcatctccactatggcctgggctccactacttctcaccctcctcgctcactgcacaggttcttgggccagttttatgctgactcagccccactctgtgtcggagtctccggggaagacggtaaccatctcctgcacccgcagcggtggctttattgccagcaataatatgcagtggtgccagcagcgcccgggcagtccccccaccactgtgatctatgaggatgaccaaagaccctctggggtccctaatcggttctctggctccgtcgacacctcctccaactctgcctacctcaccatctctggactgaagactgaggacgaggctgactattactgtcactcttatgatcgcaacaacagggtgttcggcggagggaccaggttgaccgtccttggtcagcccaaggctcgccccctcggtcactctcgtt

SEQ ID NO: 558173 - DNA, 488 bp, Homo sapiens
  misc_feature: HIJSMM301C7EP5.43.33.C11.1.454.light.4.raw
tgtgagtagtcacgaccggtgctcgatttagagtgagctcgttgggtttgggggcagaagtctctctcagtcaggacaccagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacgcgcaatgtacttctgtcaacactatgcctctcccccctacaatttcggtcaggggaccaagttgaacatcaatcgaactgtggctgcaccat

SEQ ID NO: 558174 - DNA, 485 bp, Homo sapiens
  misc_feature: HIJSMM301C1D29.41.11.A11.1.454.light.4.raw
tctatactatcacgaccggtgctcgatttagctacgactgcaggggaggaactgctcagttaggacccagacggaaccatggaagccccagcgcagcttctcttcctcctgctactctggctcccagataccactggagaaatagtggtgacgcagtctccagccaccctgtctgtgtctccaggggaaggagccaccctctcctgcagggccagtcagagtattagcagcagcttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtctt

SEQ ID NO: 558175 - DNA, 518 bp, Homo sapiens
  misc_feature: HIJSMM301BQQ9S.9.38.D05.1.454.light.4.raw
tgatacgtctcacgaccggtgctcgatttagtatctgatagttgggtttgggggctggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaataccccggcaaagcccccaaactcttgctttatgatgtcagttatcggccctcaggagtttctgatcgcttctctggctccaagtctggcaccacggcctccctgaccatctctgggctccaggctgaggacgaggctgattatttctgcagctcaaaagaagtagcctctcgtggttttcgcgggggtaccaaggtgaccgtcctaagtcagcccaaggctgccccctcggtcactctgttcccaccct

SEQ ID NO: 558176 - DNA, 416 bp, Homo sapiens; identical to SEQ ID NO: 536892
  misc_feature: HIJSMM301AL0KS.16.46.E02.1.454.light.4.raw

SEQ ID NO: 558177 - DNA, 453 bp, Homo sapiens
  misc_feature: HIJSMM301CK0V0.18.78.H01.1.454.light.4.raw
tacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccactgtcactctgtcccaccctcctccatactcgta

SEQ ID NO: 558178 - DNA, 489 bp, Homo sapiens
  misc_feature: HIJSMM301EO3TU.40.20.B09.1.454.light.4.raw
tctagcgactcacgaccggtgctcgatttagtgtagtgtgaaggggggcctcaggaagccgcatcggaggtgcctcagccatggcatggatccctctcttcctcggcgtccttgcttactgcacaggatccgtggcctcctctgagttgactcagccaccctcagtgtccgtgtcccccggacagacagccagcatcacgtgctcaggagatgatttgaacaataaacatgcttgttggtatcaacagaaaccaggccagtcccctgttctggtcatctttgaggattcaaagcggccctcagggatccctgagcgattctctggctccaagtctgcgctcacagccactctgaccatcagcgggacccagcctatggatgaggctgactattattgtcagtcgtgggacagcagcacctcttcctatgtcttcggaactgggacccaggtcaccgtcctcggtcagcccaaggccaaccccactgtca

SEQ ID NO: 558179 - DNA, 503 bp, Homo sapiens
  misc_feature: HIJSMM301A2OO4.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagatttgcagtatattactgtcagcaatatggtacttcacccggacgtcgcgacggacgaacggaggagtacaacgaacagtggctgcaccatctgtcttctactcttcccgtccact

SEQ ID NO: 558180 - DNA, 500 bp, Homo sapiens
  misc_feature: HIJSMM301EPXCA.51.83.H06.1.454.light.4.raw
cgatcgtatacacgaccggtgctcgatttagatcacgtgcgtcgcgggggaactgctcagttaggacccagagggaaccatggaagccccagctcagcttctcttcctcctgctactctgcctcccagatgccaccggacaaattgtgttgacacagtctccagtcaccctgtctttgtctccaggggaaagagccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacagacttcgctctcaccatcagcagcctagagcctgaagattttgcagtttattattgtcagcagcgaaacaactggcctccttggacgttcggccaagggaccaaggtggaaatcaaacgaactgtggctgcaccatctgtcttcatcttccccg

SEQ ID NO: 558181 - DNA, 496 bp, Homo sapiens
  misc_feature: HIJSMM301DOVTN.2.34.D01.1.454.light.4.raw
acgctcgacacacgaccggtgctcgatttagatcgtctgtgttgggtttgggggctttgcctgggctctgctcctcctcaccctcctcactcagggcacagggtcctgggcccagtctgccctgactcagcccccctccgcgtccgggtctcctggacagtcagtcaccatctcctgcactggaatcagcagtgacctgagtccttataactatgtctcctggtaccaacaacacccaggcaaagcccccaaactcattatttatgaagtcactaagcggccctcagggtccctgatcgcttctctggctccaagtctggcgagacggcctccctgaccgtctctgggctccaggctgaagatgaggctgattattactgcagctcatatgcaggcagcaacaatgtggcattcggcggagggaccaagctgaccgtcctgggtcagcccaaggctgcccctcggtcactctgttcccgcctcctctgtcgagcgt

SEQ ID NO: 558182 - DNA, 492 bp, Homo sapiens
  misc_feature: HIJSMM301EZQAT.47.36.D03.1.454.light.4.raw
agctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacttgtcgggcgagtcagggtattagcaactggttagcctggtatcaacagaaaccagggaaagcccctaacctcctcatctctactgcatccactttgcaaagtggggtcccatcaaggttcagcggcagtggatctgggacagatttcactctcactatcagcagcctgcagcctgaagtattttggaactttattattgtcaacagggtaacagtttcccgctcaccttcggcggagggaccaaggtggagatagaaaagaactgtggctgcaccat

SEQ ID NO: 558183 - DNA, 492 bp, Homo sapiens; identical to SEQ ID NO: 534967
  misc_feature: HIJSMM301DNB9I.47.64.F09.1.454.light.4.raw

SEQ ID NO: 558184 - DNA, 466 bp, Homo sapiens; identical to SEQ ID NO: 556852
  misc_feature: HIJSMM301ASEUP.48.2.A02.1.454.light.4.raw

SEQ ID NO: 558185 - DNA, 479 bp, Homo sapiens; identical to SEQ ID NO: 545213
  misc_feature: HIJSMM301ASUO7.40.59.F04.1.454.light.4.raw

SEQ ID NO: 558186 - DNA, 503 bp, Homo sapiens
  misc_feature: HIJSMM301DGMNK.5.59.F04.1.454.light.4.raw
atcagacacgcacgaccggtgctcgatttagtacacacacttagggattggggagaagagctgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctgggacagacttcactctcaccatcagcagactggagcctgaagattttgcagtgtattactgtcagcagtatggtagctcacggacgttcggccaagggaccgaacggtaggaaatacaaacgaactagtggctgcaccatctgtcttcatt

SEQ ID NO: 558187 - DNA, 502 bp, Homo sapiens
  misc_feature: HIJSMM301EG13V.9.53.E09.1.454.light.4.raw
tgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggaccaaggtgaccgtcctaggtcagcccaaggctgccccc

SEQ ID NO: 558188 - DNA, 488 bp, Homo sapiens
  misc_feature: HIJSMM301AGJ4E.10.59.F04.1.454.light.4.raw
catagtagtgcacgaccggtgctcgatttagtacacacacttagggattggggggggtcgtcaggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcaccatctcctgcactggaaccagcagtgatgttggtggttatgactttgtctcctggtaccaacagcagccaggcgaagcccccaaattcatgatttatgatgtcagtgcgcggccctcgggggtccctgatcgcttctctggctccaagtctggcaacacggcctccctgaccatctctggcctccagcctgaggatgaggctgattattactgttgctcatatgcaggcggtaccgcttgggtgttcggcggagggaccaagctgaccgtctaggtcagcccg

SEQ ID NO: 558189 - DNA, 494 bp, Homo sapiens; identical to SEQ ID NO: 537003
  misc_feature: HIJSMM301BIZS7.10.79.H02.1.454.light.4.raw

SEQ ID NO: 558190 - DNA, 444 bp, Homo sapiens; identical to SEQ ID NO: 535594
  misc_feature: HIJSMM301D5UZ9.9.9.A09.1.454.light.4.raw

SEQ ID NO: 558191 - DNA, 506 bp, Homo sapiens
  misc_feature: HIJSMM301CYUVM.22.21.B10.1.454.light.4.raw
acatacgcgtcacgaccggtgctcgatttagtgtcgtcgcaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccacccaggcacagcccccaaactcatgatttatgaggtcactaagcgggcctcaggggtccctgatcgcttctctggctccaagtctggcgacacggcctccctgaccgtctctgggctccaggctgaggatgaggctgattattactgctactcatatgcaggcggcaactcttgggtgttcggcggagggaccaagctgaccgtcctaggtcagcccaaggctgccccctccggtcactcttcg

SEQ ID NO: 558192 - DNA, 443 bp, Homo sapiens
  misc_feature: HIJSMM301AXOUQ.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggtaccgcagcctccctggccatcactgggctccgggctgaggatgaggctgattattactgccaggcccttgacaacagtttgggtgtttgggtgttcggcggagggaccaagctgaccgtcctaagtcagcccaaggctgccccctcggtcactctgttcccgccctcctccgttctgat

SEQ ID NO: 558193 - DNA, 510 bp, Homo sapiens
  misc_feature: HIJSMM301DWXHK.49.87.H10.1.454.light.4.raw
agtcgagagacacgaccggtgctcgatttagcagtactgcgttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaatacccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacataaacacttgggtgttcggcggcgggaccaaactgaccgtcctacgtcagcccaaggctgccccctcggtcact

SEQ ID NO: 558194 - DNA, 444 bp, Homo sapiens; identical to SEQ ID NO: 535594
  misc_feature: HIJSMM301D4PJW.9.9.A09.1.454.light.4.raw

SEQ ID NO: 558195 - DNA, 462 bp, Homo sapiens
  misc_feature: HIJSMM301C29GT.11.73.G07.1.454.light.4.raw
cgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctgatctacgatgcgtccaatttggaaacagaggtcccaccgaggttcagtggaagtggatctgggacagactttactctcaccatcagcagcctgcagcctgaagatattgcaacatattactgtcaacagtatgatcgtctcctcaatttcggccctgggaccagagtgacatgaaacgaa

SEQ ID NO: 558196 - DNA, 383 bp, Homo sapiens; identical to SEQ ID NO: 540698
  misc_feature: HIJSMM301CM65C.41.28.C06.1.454.light.4.raw

SEQ ID NO: 558197 - DNA, 484 bp, Homo sapiens
  misc_feature: HIJSMM301B8G8R.47.60.F05.1.454.light.4.raw
agctcacgtacacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgctagtttattactgtcagcagtatcatgactggccgctcaccttcggccaagggcacgactggagattaaacgaactgtggctgcaccat

SEQ ID NO: 558198 - DNA, 491 bp, Homo sapiens; identical to SEQ ID NO: 536211
  misc_feature: HIJSMM301AQJ8I.16.53.E09.1.454.light.4.raw

SEQ ID NO: 558199 - DNA, 502 bp, Homo sapiens; identical to SEQ ID NO: 536253
  misc_feature: HIJSMM301ARW2F.21.22.B11.1.454.light.4.raw

SEQ ID NO: 558200 - DNA, 509 bp, Homo sapiens; identical to SEQ ID NO: 547302
  misc_feature: HIJSMM301C9JH2.4.57.F02.1.454.light.4.raw

SEQ ID NO: 558201 - DNA, 506 bp, Homo sapiens
  misc_feature: HIJSMM301BSIVG.47.83.H06.1.454.light.4.raw
agctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatactcccccagctggtaccagcagaccccgggccagactccacgcacgctcatctacaacacagacactcgctcttctggggtccctgatcgcttctctggttccatccttgggaacaaagctgccctcaccatcgcgggggcccaggcagatgatgagtgtgattattactgtgtgctctatatgggcagtggcgtttgggtgttcggcggagggaccaagctgaccgttc

SEQ ID NO: 558202 - DNA, 485 bp, Homo sapiens; identical to SEQ ID NO: 552583
  misc_feature: HIJSMM301EPWER.40.83.H06.1.454.light.4.raw

SEQ ID NO: 558203 - DNA, 486 bp, Homo sapiens; identical to SEQ ID NO: 535043
  misc_feature: HIJSMM301DJ8J7.46.35.D02.1.454.light.4.raw

SEQ ID NO: 558204 - DNA, 491 bp, Homo sapiens; identical to SEQ ID NO: 539402
  misc_feature: HIJSMM301BHX2I.13.5.A05.1.454.light.4.raw

SEQ ID NO: 558205 - DNA, 490 bp, Homo sapiens; identical to SEQ ID NO: 541244
  misc_feature: HIJSMM301CKEJH.41.44.D11.1.454.light.4.raw

SEQ ID NO: 558206 - DNA, 489 bp, Homo sapiens; identical to SEQ ID NO: 535091
  misc_feature: HIJSMM301ECEVP.47.36.D03.1.454.light.4.raw

SEQ ID NO: 558207 - DNA, 479 bp, Homo sapiens; identical to SEQ ID NO: 535118
  misc_feature: HIJSMM301B0R33.13.59.F04.1.454.light.4.raw

SEQ ID NO: 558208 - DNA, 496 bp, Homo sapiens; identical to SEQ ID NO: 556037
  misc_feature: HIJSMM301ALHEC.41.38.D05.1.454.light.4.raw

SEQ ID NO: 558209 - DNA, 486 bp, Homo sapiens; identical to SEQ ID NO: 535917
  misc_feature: HIJSMM301BRHTD.3.10.A10.1.454.light.4.raw

SEQ ID NO: 558210 - DNA, 496 bp, Homo sapiens; identical to SEQ ID NO: 535109
  misc_feature: HIJSMM301E2D2S.16.78.H01.1.454.light.4.raw

SEQ ID NO: 558211 - DNA, 508 bp, Homo sapiens
  misc_feature: HIJSMM301EOV3R.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggaggaccaagttgaccgtctaggtcagcccaaggctcgccccctcggtcactctgtt

SEQ ID NO: 558212 - DNA, 510 bp, Homo sapiens
  misc_feature: HIJSMM301CT3XC.48.53.E09.1.454.light.4.raw
agtatacatacacgaccggtgctcgatttagagagagtgtgttgggtttgggggctgtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagccaaggctgccccctcggtcactctgttccccg

SEQ ID NO: 558213 - DNA, 509 bp, Homo sapiens; identical to SEQ ID NO: 557518
  misc_feature: HIJSMM301AIRNS.8.34.D01.1.454.light.4.raw

SEQ ID NO: 558214 - DNA, 510 bp, Homo sapiens; identical to SEQ ID NO: 540313
  misc_feature: HIJSMM301AOQTE.48.11.A11.1.454.light.4.raw

SEQ ID NO: 558215 - DNA, 476 bp, Homo sapiens
  misc_feature: HIJSMM301DOSPK.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcactttcggcctgggactgaagtgcatatgaagagaactgtggctgcta

SEQ ID NO: 558216 - DNA, 502 bp, Homo sapiens; identical to SEQ ID NO: 540270
  misc_feature: HIJSMM301CFZW8.27.78.H01.1.454.light.4.raw

SEQ ID NO: 558217 - DNA, 482 bp, Homo sapiens
  misc_feature: HIJSMM301C3H69.17.34.D01.1.454.light.4.raw
cgtagactagcacgaccggtgctcgatttagatcgtctgtgttgggtttgggtcatcacaatatctgcactggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttcctccgacgttcggccaagggaccaaggtggaactcaaacgaactgtggctgcaccatctgtcttcatcttcccgccatctgactagtcta

SEQ ID NO: 558218 - DNA, 499 bp, Homo sapiens; identical to SEQ ID NO: 542463
  misc_feature: HIJSMM301CFKGZ.26.26.C04.1.454.light.4.raw

SEQ ID NO: 558219 - DNA, 447 bp, Homo sapiens; identical to SEQ ID NO: 535201
  misc_feature: HIJSMM301BMMFV.18.9.A09.1.454.light.4.raw

SEQ ID NO: 558220 - DNA, 488 bp, Homo sapiens; identical to SEQ ID NO: 541868
  misc_feature: HIJSMM301C05TV.14.55.E11.1.454.light.4.raw

SEQ ID NO: 558221 - DNA, 474 bp, Homo sapiens
  misc_feature: HIJSMM301CVGDA.12.49.E05.1.454.light.4.raw
atacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagcaattttttagcctggtatcagcagaaaccagggaaagttccacacctcctgatctatgctgcatccgctttgcaatcaggggtcccatctcggttcagcggcagtggatctgggacagagttcactctcaccatcagcagcctgcagcctgaagatgttgcaacttattactgtcaaaagtataacagtgcccccttcaccttcggccaagggacacgactggagattagaacg

SEQ ID NO: 558222 - DNA, 454 bp, Homo sapiens; identical to SEQ ID NO: 534964
  misc_feature: HIJSMM301EPOBP.19.86.H09.1.454.light.4.raw

SEQ ID NO: 558223 - DNA, 485 bp, Homo sapiens; identical to SEQ ID NO: 547841
  misc_feature: HIJSMM301EQXNC.26.60.F05.1.454.light.4.raw

SEQ ID NO: 558224 - DNA, 501 bp, Homo sapiens; identical to SEQ ID NO: 536818
  misc_feature: HIJSMM301AMCPI.12.82.H05.1.454.light.4.raw

SEQ ID NO: 558225 - DNA, 511 bp, Homo sapiens
  misc_feature: HIJSMM301AK85Z.11.57.F02.1.454.light.4.raw
  modified_base (458)..(458): a, c, t, g, unknown or other
cgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaaggaccaaggnggaagtcaagcgaactgtggctgcaccatctgtcttcatcttcccgtcccact

SEQ ID NO: 558226 - DNA, 495 bp, Homo sapiens
  misc_feature: HIJSMM301B91QW.49.29.C07.1.454.light.4.raw
agtcgagagacacgaccggtgctcgatttagagtgctacgaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttggaactgcgaccaaggtcaccgtcctgggtcagcccaaggccaaccccactgtca

SEQ ID NO: 558227 - DNA, 508 bp, Homo sapiens; identical to SEQ ID NO: 551099
  misc_feature: HIJSMM301AG9QP.8.28.C06.1.454.light.4.raw

SEQ ID NO: 558228 - DNA, 491 bp, Homo sapiens; identical to SEQ ID NO: 535294
  misc_feature: HIJSMM301A8ZY2.16.68.G02.1.454.light.4.raw

SEQ ID NO: 558229 - DNA, 516 bp, Homo sapiens
  misc_feature: HIJSMM301B0FHK.51.43.D10.1.454.light.4.raw
cgatcgtatacacgaccggtgctcgatttagactagcagtaaggggctgggcctaaggaagcagcactggtggtgcctcagccatggcctggaccgttctcctcctcggcctcctctctcactgcacagtctctgtgacatcctatgtgctgactcagccaccctcggtgtcagtggccccaggacagacggccaggatttcctgtgggggagacaacattggaagtaaaagtgtacactggtaccagcagaggccaggccaggcccctgtgttggtcgtctatgattataacgaccggccctcagggatccctgaccgattctctggctccatctctgggaacacggccactctgaccatcagcagggtcgaagccggggatgaggccgactattactgtcaggtgtgggaaagtagtagtgatcattatgtcttcggaagtgggaccaaggtcaccgtcctaggtcagcccaaggccaaccccactgtcactctgttcccaccctccctctcgt

SEQ ID NO: 558230 - DNA, 474 bp, Homo sapiens; identical to SEQ ID NO: 538184
  misc_feature: HIJSMM301B4MCX.13.76.G10.1.454.light.4.raw

SEQ ID NO: 558231 - DNA, 483 bp, Homo sapiens; identical to SEQ ID NO: 535413
  misc_feature: HIJSMM301ER1ED.26.78.H01.1.454.light.4.raw

SEQ ID NO: 558232 - DNA, 479 bp, Homo sapiens; identical to SEQ ID NO: 538734
  misc_feature: HIJSMM301ALRLI.8.53.E09.1.454.light.4.raw

SEQ ID NO: 558233 - DNA, 488 bp, Homo sapiens
  misc_feature: HIJSMM301EVJK2.43.34.D01.1.454.light.4.raw
tgtgagtagtcacgaccggtgctcgatttagatcgtctgtgttgggtttgggcacgaccggtgctcgatttagatcgtctgtgttgggtttgggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaaagcccccaaactcatgatttatgagggcactaagcggccctcaggggtttctgatcgcttctctggctccaagtctggcaacacggcctccctgacaatctctgggctccaggctgaggacgaggctgattattactgtgcagcgtgggatgacagcctgaatgctt

SEQ ID NO: 558234 - DNA, 484 bp, Homo sapiens; identical to SEQ ID NO: 536162
  misc_feature: HIJSMM301DUOAZ.13.59.F04.1.454.light.4.raw

SEQ ID NO: 558235 - DNA, 487 bp, Homo sapiens
  misc_feature: HIJSMM301DDVNB.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtgggtcccatcaaggttcagcggcagtgggtctgggacagaattcactctcaccatcagcagcctgcaacctgatgactttgcaacttattactgccaacagtataatggttatgaatccacttttggccaagggccaagctggagatcaaacgaactgtggctgcacca

SEQ ID NO: 558236 - DNA, 466 bp, Homo sapiens; identical to SEQ ID NO: 535366
  misc_feature: HIJSMM301D3RB6.13.4.A04.1.454.light.4.raw

SEQ ID NO: 558237 - DNA, 510 bp, Homo sapiens
  misc_feature: HIJSMM301E23A8.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttccggccaagggacgacgactacggagaattaaacgaaactacgtggtcgtcgcacccaactcttgtcttt

SEQ ID NO: 558238 - DNA, 500 bp, Homo sapiens
  misc_feature: HIJSMM301BVBZF.53.68.G02.1.454.light.4.raw
cgcgtatacacacgaccggtgctcgatttagtcgatagtgaagggaaagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaagaaaatatgcttattggtaccaacagaggtcaggccaggcccctgtgctggtcatctatgaggacaccaaacgaccctccgggatccctgcgagattctctggcgccagctcagggacagtggccaccctgacagtcagtggggcccaggtggaggatgaagctgattactactgttactcaacagacaggagtggaaatcatagggtattcggcggagggaccaagctgaccgtctaggtcagcccaaggctgccccctcggtcact

SEQ ID NO: 558239 - DNA, 505 bp, Homo sapiens; identical to SEQ ID NO: 536117
  misc_feature: HIJSMM301CS6PB.8.71.G05.1.454.light.4.raw

SEQ ID NO: 558240 - DNA, 505 bp, Homo sapiens
  misc_feature: HIJSMM301ANHD6.40.67.G01.1.454.light.4.raw
tctagcgactcacgaccggtgctcgatttagagtatacatattgggtttgggggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccagggccactggcgtcccggccaggttcagtggcagtgggtctgggacagccttcactctcaccatcagcagcctggagcccgaagattttgcggtttattactgtcagcagcgtgccgactggccccctcacgttcggcggagggaccaaggtggacatcaaacgaactgtggctgcaccatctgtcttcatcttcccgccat

SEQ ID NO: 558241 - DNA, 493 bp, Homo sapiens; identical to SEQ ID NO: 535084
  misc_feature: HIJSMM301CPUT4.47.64.F09.1.454.light.4.raw

SEQ ID NO: 558242 - DNA, 523 bp, Homo sapiens; identical to SEQ ID NO: 556310
  misc_feature: HIJSMM301DWSYL.5.27.C05.1.454.light.4.raw

SEQ ID NO: 558243 - DNA, 495 bp, Homo sapiens
  misc_feature: HIJSMM301CSXPG.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccagacaaagcccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctactcttttctcttcggaactgggaccacggtcaccgtcctaggtcagcccaaggccaacccca

SEQ ID NO: 558244 - DNA, 515 bp, Homo sapiens
  misc_feature: HIJSMM301C7ZYE.40.27.C05.1.454.light.4.raw
tctagcgactcacgaccggtgctcgatttagacgcgatcgaagggtttgggcagcttcagctgtggtggagaagacaggattcaggccaatctccagcatggccggcttccctctcctcctcaccctcctcactcactgtgcagggtcctgggcccagtctgtgctgactcagccaccctcagcgtctgagacccccgggcagcaggttaccgtctcttgttctggaagcagctccaacatcggaagtaattctgtatactggtaccagtgcctcccaggaacggcccccaaacttctcgtctatagggattatcagcggcccttaggggtccctgaccgattctctggctccaggtctggcacctcagcctccctggccatcagtgggctccggcccgaggatgaggcggattattattgtgtgtcatgggatgacagaatgaatggtccggtgttcggcggagggaccaggctgaccgtcctaggtcagcccaaggctgccccctcggtcact

SEQ ID NO: 558245 - DNA, 455 bp, Homo sapiens; identical to SEQ ID NO: 535447
  misc_feature: HIJSMM301AWQB4.19.71.G05.1.454.light.4.raw

SEQ ID NO: 558246 - DNA, 454 bp, Homo sapiens; identical to SEQ ID NO: 534964
  misc_feature: HIJSMM301B3RV8.19.86.H09.1.454.light.4.raw

SEQ ID NO: 558247 - DNA, 507 bp, Homo sapiens
  misc_feature: HIJSMM301BTJWN.43.67.G01.1.454.light.4.raw
tgtgagtagtcacgaccggtgctcgatttagagtatacatattgggtttggggacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgttatactccgccgacgttcggccggggaccgaccgtggaatcaaacgaactagtggctgcaccatctgtcttcatt

SEQ ID NO: 558248 - DNA, 521 bp, Homo sapiens; identical to SEQ ID NO: 538715
  misc_feature: HIJSMM301DBCPJ.27.23.C01.1.454.light.4.raw

SEQ ID NO: 558249 - DNA, 494 bp, Homo sapiens; identical to SEQ ID NO: 542264
  misc_feature: HIJSMM301CW616.13.6.A06.1.454.light.4.raw

SEQ ID NO: 558250 - DNA, 489 bp, Homo sapiens
  misc_feature: HIJSMM301DIS8H.17.55.E11.1.454.light.4.raw
cgtagactagcacgaccggtgctcgatttagcactcgcacgttgggtttgagggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacagtaagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcctctcactttcggcggaggaccaaggtggagatcaaacgaactgt

SEQ ID NO: 558251 - DNA, 496 bp, Homo sapiens
  misc_feature: HIJSMM301CZVE3.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtctgcagtataataactggcctccacggtacacttttggccaggggaccaagctggagatcaaacgaactgtggctgcaccatctgt

SEQ ID NO: 558252 - DNA, 505 bp, Homo sapiens
  misc_feature: HIJSMM301BA6ED.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtctaggtcagcccaaggccaaccccactgtca

SEQ ID NO: 558253 - DNA, 519 bp, Homo sapiens
  misc_feature: HIJSMM301AMJDN.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctcgccccctcggtcactctcgttcccaccctccctcc

SEQ ID NO: 558254 - DNA, 504 bp, Homo sapiens
  misc_feature: HIJSMM301ECOQX.9.12.B01.1.454.light.4.raw
  modified_base (423)..(423): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaaacngttttctcgggcgttcggccaagggaccaaggtaggaaatcaaacgaactgtggctgcaccatctgtcttcatcttccccg

SEQ ID NO: 558255 - DNA, 487 bp, Homo sapiens
  misc_feature: HIJSMM301CXZ8K.12.33.C11.1.454.light.4.raw
atacgacgtacacgaccggtgctcgatttagagtgagctcgttgggtttgggggcaggagtcagtctcagtcaggacacagcatggacatgagggtccccgctcagctcctggggctcctgctactctggctccgaggtgccagatgtgacatccagatgacccagtctccttcctccctgtctgcatctgtcggagacagcgtcaccatcacttgtcgggcaagtcagaacatttacaattatttaaattggtatcagcagaaaccagggaaagcccctaaactcctgatctatcatgaatccagtttgcgaagtggagtcccatcaaggttcagtggcactgggtctgagacagagttcactctcaccatcagcactctacagcctgaagattttgcaacttattattgtcaacaaagttatgagacccctgccactttcggccctgggaccatagtggatatagaaacgaactgtggctgcacc

SEQ ID NO: 558256 - DNA, 504 bp, Homo sapiens
  misc_feature: HIJSMM301DN0HP.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgtttggtcttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccaaactgaccgtcctaggtcagcccaaggctgccccctcgg

SEQ ID NO: 558257 - DNA, 504 bp, Homo sapiens
  misc_feature: HIJSMM301DQ3G8.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggccccaaaattggtcatctatgaagacgacaaacgaccctccgggatccctgagagattctctggctccagctcagggactatggccaccttgactatcagtgggcccaagtggaggatgaagctgactactactgttactcaatagagaacagtgataatttctgggtgttcgggcggagggaccaaactgaccgtcctaggtcagcccaaggctgccccctcggtcactctgtt

SEQ ID NO: 558258 - DNA, 491 bp, Homo sapiens
  misc_feature: HIJSMM301C652S.14.55.E11.1.454.light.4.raw
  modified_base (453)..(453): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcacttcggtcggagggaccaaggcggngaatcagaacgaactgtggctgcaccatctgtcttcta

SEQ ID NO: 558259 - DNA, 513 bp, Homo sapiens
  misc_feature: HIJSMM301D3PVZ.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaacggcccccaaactcctcatctataggaataatcagcggccctcaggggtccctgaccgattctctggctccaaggctggcacctcagcctccctggccatcagtgggctccggtccgaggatgaggctgattattactgtgcagcatgggatgacagcctgagtggtccttgggtgttcggcggagggaccaagctgaccgtcctaagtcagcccaaggctgccccctggtcactctgttcccacctcctcg

SEQ ID NO: 558260 - DNA, 494 bp, Homo sapiens; identical to SEQ ID NO: 535629
  misc_feature: HIJSMM301EPLRU.4.27.C05.1.454.light.4.raw

SEQ ID NO: 558261 - DNA, 468 bp, Homo sapiens
  misc_feature: HIJSMM301EXWX2.40.10.A10.1.454.light.4.raw
tctagcgactcacgaccggtgctcgatttagcgtcgatctcagggggcaggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagcggcagtggatctggcacagagttcactctcaccatcagcaccctgcagcctgaagattttgcgacttatttctgtctacaagattctaattaccctcggacgttcggccagggaccgaaacgtaggatgtcaaccgaa

SEQ ID NO: 558262 - DNA, 490 bp, Homo sapiens
  misc_feature: HIJSMM301EWZG6.21.65.F10.1.454.light.4.raw
tcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaaacctggccagcctcccaggctcctcatctatggtgcatccgccagggccactggaatcccagccaggttcagtggcactgggtctgggacagagttcactctcaccatcagcagcctgcagtctgaagattttgaagtttatttctgtctgcagtacaatcagtggcctcggacgttcgccgaagggaccgaaggtggaaatcaaacgaactgtggctgcaccatctgtcttcta

SEQ ID NO: 558263 - DNA, 493 bp, Homo sapiens; identical to SEQ ID NO: 535770
  misc_feature: HIJSMM301BFXMT.51.71.G05.1.454.light.4.raw

SEQ ID NO: 558264 - DNA, 506 bp, Homo sapiens; identical to SEQ ID NO: 547367
  misc_feature: HIJSMM301BCSAB.16.46.E02.1.454.light.4.raw

SEQ ID NO: 558265 - DNA, 516 bp, Homo sapiens
  misc_feature: HIJSMM301DT4IA.12.71.G05.1.454.light.4.raw
  modified_base (512)..(512): a, c, t, g, unknown or other
atacgacgtacacgaccggtgctcgatttagtgtcgtcgcaagagagaggggggatgaggagcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaaagtgaccgtcctaagtcagcccaaggctgccccctcggtcactctgttcccnccct

SEQ ID NO: 558266 - DNA, 509 bp, Homo sapiens
  misc_feature: HIJSMM301BN433.48.36.D03.1.454.light.4.raw
agtatacatacacgaccggtgctcgatttagctgcgtcacgatctctcttggggggggtcgtcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgaccatctctgggctccaggctgaagatcaggctgattattactgctgttcattttctaagttccttttttgttcttcggaactgggaccgaggtcaccgtcctaggtcagcccaaggccaacccccactgtcta

SEQ ID NO: 558267 - DNA, 444 bp, Homo sapiens; identical to SEQ ID NO: 534993
  misc_feature: HIJSMM301EAK1Q.5.9.A09.1.454.light.4.raw

SEQ ID NO: 558268 - DNA, 503 bp, Homo sapiens
  misc_feature: HIJSMM301EJUT2.16.81.H04.1.454.light.4.raw
tgtactactccacgaccggtgctcgatttagtagtgtagattcgcgggggagtcagactcagtcaggacacagcatggacatgagggtccccgctcagctcctggggctcctgctgctctggttcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaactttcggccctgggaccaatgtgggtatctaacgaaacgtaacgtggtcgtcgtcgaccaacctactctcgttctta

SEQ ID NO: 558269 - DNA, 444 bp, Homo sapiens; identical to SEQ ID NO: 535027
  misc_feature: HIJSMM301DJY0L.8.73.G07.1.454.light.4.raw

SEQ ID NO: 558270 - DNA, 498 bp, Homo sapiens
  misc_feature: HIJSMM301C46X1.2.49.E05.1.454.light.4.raw
acgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccgggcagagggtcaccatctcttgttctggaagcatgtccaacatcggaagtgataatgtatactggtaccagcagttcccaagagcggccccaagctcctcatctatagaattatgaacggtcctcaggggtccctgaccgattctctggctccaagtctggcacctcagcctccctggccatcagtgggctccggtccgaggatgaggctgattattactgtgttggatgggacagcagcctgagtgcttatgtcttcggaactgggaccacggtcaccgtcctaggt

SEQ ID NO: 558271 - DNA, 485 bp, Homo sapiens
  misc_feature: HIJSMM301EDQMC.41.57.F02.1.454.light.4.raw
tctatactatcacgaccggtgctcgatttagctcgatatagttgggtttggggtccaaacagagcttcagcaagcatagtgggaatctgcaccatgccctgggctctgctcctcctgaccctcctcactcactctgcagtgtcagtggtccaggcaggactgactcagccaccctcggtgtccaagggcttgagacagaccgccacactcacctgcactgggaacagctacaatgttggcaacgaaggagcagcttggctgcagcagtaccagggccaccctcccaaattgctatcatacaggaagaacaaccgcccctcggggatctccgagagattctctgcatcaacgtcaggaaacatagcctccctgaccattactggactccagcctgaggacgaggctgactattactgctcagcatgggacagcagcctcaatgttggtgttcggcggagggaccaagctgaccgtcctaggtcacg

SEQ ID NO: 558272 - DNA, 517 bp, Homo sapiens
  misc_feature: HIJSMM301AJ1IS.22.65.F10.1.454.light.4.raw
  modified_base (487)..(487): a, c, t, g, unknown or other
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgcccccccgactcaccctacggtccgaacgggacggaaccgaccgtaggtaggaattaaacgtaaaaccgngttgggctgcaccactctcgttcttctatt

SEQ ID NO: 558273 - DNA, 497 bp, Homo sapiens; identical to SEQ ID NO: 546363
  misc_feature: HIJSMM301CWOVV.12.37.D04.1.454.light.4.raw

SEQ ID NO: 558274 - DNA, 491 bp, Homo sapiens
  misc_feature: HIJSMM301BEK2R.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaacaacctgcaggctgaagatgtggcagtttattactgtcagcaatactatagtcctcctctcacgttcggcggagggaccaaggtggagatcaaacgactgtggctgcaccatctgtcttcatcttcccgccat

SEQ ID NO: 558275 - DNA, 481 bp, Homo sapiens
  misc_feature: HIJSMM301D55RM.48.73.G07.1.454.light.4.raw
agtatacatacacgaccggtgctcgatttagctctacgctcagggcacgaccggtgctcgatttagtatctgatagttgggtttggggctgtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggc

SEQ ID NO: 558276 - DNA, 505 bp, Homo sapiens; identical to SEQ ID NO: 535503
  misc_feature: HIJSMM301D7LW5.8.28.C06.1.454.light.4.raw

SEQ ID NO: 558277 - DNA, 463 bp, Homo sapiens; identical to SEQ ID NO: 535062
  misc_feature: HIJSMM301AO30Q.11.73.G07.1.454.light.4.raw

SEQ ID NO: 558278 - DNA, 486 bp, Homo sapiens; identical to SEQ ID NO: 535043
  misc_feature: HIJSMM301CWL0T.46.35.D02.1.454.light.4.raw

SEQ ID NO: 558279 - DNA, 441 bp, Homo sapiens
  misc_feature: HIJSMM301DATRB.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggaccccacgtaaccgtcctaggtcagcccaaggctgccccctcggtcactctgttcccgccctcccgtatctctcg

SEQ ID NO: 558280 - DNA, 501 bp, Homo sapiens; identical to SEQ ID NO: 550139
  misc_feature: HIJSMM301DNM4S.15.56.F01.1.454.light.4.raw

SEQ ID NO: 558281 - DNA, 501 bp, Homo sapiens
  misc_feature: HIJSMM301D5IKE.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatggggatgacaatctgagcggttgggtgttcggcggagggaccaaactgaccgtcctaggtcagccc

SEQ ID NO: 558282 - DNA, 494 bp, Homo sapiens
  misc_feature: HIJSMM301C5N5O.13.11.A11.1.454.light.4.raw
tcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagcctacatcacctgctctggagatgtattgactaacgagtatggttcctggtatcagcagaaggcaggccagccccctgtcctactcatctttcaaataccaggcggccctctggggtccctgagcgattctccggctccgcctctgggaacacagtcactctgaccatcagcgggacccagcctattgatgaggctgtctacttctgtcaggcgtgggacaacagcgtgctgttcggcggagggaccagtctgaccgtcttaggtcagcccaaggcctgccccctcggtcactctgtcccta

SEQ ID NO: 558283 - DNA, 495 bp, Homo sapiens; identical to SEQ ID NO: 542571
  misc_feature: HIJSMM301B492R.7.59.F04.1.454.light.4.raw

SEQ ID NO: 558284 - DNA, 509 bp, Homo sapiens
  misc_feature: HIJSMM301ATIKC.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcgtccaagggaccgaaggtaggaaatacaaacgaactagtggcgtgcaccactctgtcttctatcttccccg

SEQ ID NO: 558285 - DNA, 493 bp, Homo sapiens
  misc_feature: HIJSMM301DMORN.48.1.A01.1.454.light.4.raw
agtatacatacacgaccggtgctcgatttagacgtctcatcagggggcaggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaattttcgctgtctccagtttgcagagtggagtcccatctcggttcagcggcagtggatctggggcagagttcattctcaccatcaacagccttcagcctgaagattttgcaacttactattgtcagcagggtgacagtttccctcccactttcggcggagggaccgagggtggacgtcaaacgaactgtggctgcaccatctgtcttcatt

SEQ ID NO: 558286 - DNA, 487 bp, Homo sapiens; identical to SEQ ID NO: 537573
  misc_feature: HIJSMM301A3M5G.3.10.A10.1.454.light.4.raw

SEQ ID NO: 558287 - DNA, 486 bp, Homo sapiens; identical to SEQ ID NO: 535043
  misc_feature: HIJSMM301CB22W.46.35.D02.1.454.light.4.raw

SEQ ID NO: 558288 - DNA, 491 bp, Homo sapiens; identical to SEQ ID NO: 535294
  misc_feature: HIJSMM301AH56Z.16.68.G02.1.454.light.4.raw

SEQ ID NO: 558289 - DNA, 496 bp, Homo sapiens
  misc_feature: HIJSMM301DZ7LW.21.27.C05.1.454.light.4.raw
  modified_base (198)..(198): a, c, t, g, unknown or other
tcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttagcctggtaccagcagaaatctggccaggctcccaggctcctcatttaccgtgcatccaccagggccactggtgtcccagacaggttcagtggcggtggatttgggacagagttttctctcaccatcagcgccctacagagtgaagatgttgcagtttatttctgccagcaatataattactggcctgcgtcgacgttcggccacgggaccaaggtggaaatcaaacgaactagtggctgcaccatctgtctt

SEQ ID NO: 558290 - DNA, 507 bp, Homo sapiens
  misc_feature: HIJSMM301BESJ0.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaaggtaggaaatacaaacgaactagtggctgcaccatctgtcttctatcttccccg

SEQ ID NO: 558291 - DNA, 473 bp, Homo sapiens
  misc_feature: HIJSMM301AHQKM.52.59.F04.1.454.light.4.raw
cgcagtacgacacgaccggtgctcgatttagtacacacacttagggattgggggcagaagtctctctcagccaggacacagcatggacatgagggtccctgctcagctcctgggactcctgctgctctggctcccagataccagatgtgacatccagatgacccagtctccatcctccctgtctgcatctgttggagacagagtcaccatctcttgccgggcgagtcaggtcattaacagttatttagcctggtatcagcaaaaaccagggcaagttcctgaactcctgatctatgacacatccactttgcaatcaggggtcccatctcggttcgttggcagtgggtctgggacagattttactctcaccatcagcagcctgcagcctgaagatgttgcaacttatttctgtcataactatgatgatgcccctcacacgttcggccaagggaccaagctggaaatcaaacgaa

SEQ ID NO: 558292 - DNA, 489 bp, Homo sapiens; identical to SEQ ID NO: 536013
  misc_feature: HIJSMM301AZFX5.26.23.C01.1.454.light.4.raw

SEQ ID NO: 558293 - DNA, 503 bp, Homo sapiens
  misc_feature: HIJSMM301CRW9V.41.3.A03.1.454.light.4.raw
tctatactatcacgaccggtgctcgatttagagagcgtcacaggggagagctgctcagttaggacccagagggaaccatggaaaccccagcgcagcttctcttcctcctgctactctggctcccaggtgccaccggagaaattgtgttgacgcagtctccaggcaccctgtctttctctccaggggaaagagccaccctctcctgcagggccagtcagagtgttgacaaccagtacttcgcctggtaccagcagaaacctggccaggctcccaggctcctcatggatggtgcatccagcagggccactggcatcccagacaggttcggtggcagtgggtctgggacagacttcactctcaccatcagcagcctggagcctgaagattttgtagtgtattactgtcagcagtatcttacaacgaccgggaggtttgtcgacgggacgaagacgtggaggataccaaacgaaaccgagttggcgtgcaccactcttgtctttcta

SEQ ID NO: 558294 - DNA, 498 bp, Homo sapiens
  misc_feature: HIJSMM301ES0J3.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccaagggaccaaggtggaaatacaacgaactgtggctgcacc

SEQ ID NO: 558295 - DNA, 486 bp, Homo sapiens; identical to SEQ ID NO: 535043
  misc_feature: HIJSMM301DZV4J.46.35.D02.1.454.light.4.raw

SEQ ID NO: 558296 - DNA, 489 bp, Homo sapiens; identical to SEQ ID NO: 542052
  misc_feature: HIJSMM301DGTG5.10.77.G11.1.454.light.4.raw

SEQ ID NO: 558297 - DNA, 504 bp, Homo sapiens; identical to SEQ ID NO: 535495
  misc_feature: HIJSMM301BCJSZ.14.86.H09.1.454.light.4.raw

SEQ ID NO: 558298 - DNA, 487 bp, Homo sapiens
  misc_feature: HIJSMM301BE51Y.19.71.G05.1.454.light.4.raw
tactctcgtgcacgaccggtgctcgatttagtgtcgtcgcaagagagaggggggaggtacaacaggcaggcaggggcgagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaa

SEQ ID NO: 558299 - DNA, 415 bp, Homo sapiens
  misc_feature: HIJSMM301BAQ2P.16.46.E02.1.454.light.4.raw
tgtactactccacgaccggtgctcgatttagactcatctacagggaaagggggctgtgcctggggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaaccccactgtcactctgttcccaccctcccgagtagtaca

SEQ ID NO: 558300 - DNA, 488 bp, Homo sapiens; identical to SEQ ID NO: 535990
  misc_feature: HIJSMM301EPIZH.11.28.C06.1.454.light.4.raw

SEQ ID NO: 558301 - DNA, 454 bp, Homo sapiens; identical to SEQ ID NO: 534964
  misc_feature: HIJSMM301B3WDM.19.86.H09.1.454.light.4.raw

SEQ ID NO: 558302 - DNA, 490 bp, Homo sapiens
  misc_feature: HIJSMM301B273O.5.45.E01.1.454.light.4.raw
atcagacacgcacgaccggtgctcgatttagtgagtcagtaagggaaaggggggggcacttctccctctaacactctccccgctcagctcctggggctcctgctgctctggttcccaggttccagatgcgacatccagatgacccagtctccttctttcgtgtctgcgtctgtaggagacagacttactatcgcttgtcgggcgagtcaggatattagtaccaggttagcctggtatcagcagaagcctgggagagcccctaaactcctgatctatgctgcatcaagtctgcaaagtggggtcccatcgaggttcagaggcagtggatctgggacagatttcactctcaccatcagcggcctgcagcctgaagattatgcaacttactattgtcaaagttctaatgctttcccgcgcacgtttggccaggggaccaaggtagagatcaaaacgaactgtggctgcaccatctgtcttcatcttcccgcat

SEQ ID NO: 558303 - DNA, 472 bp, Homo sapiens
  misc_feature: HIJSMM301CGBJ6.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctcctccgagtgccacttttggcgggggtaccaaggtggacatcaaacgaa

SEQ ID NO: 558304 - DNA, 434 bp, Homo sapiens; identical to SEQ ID NO: 536762
  misc_feature: HIJSMM301D7RC3.48.1.A01.1.454.light.4.raw

SEQ ID NO: 558305 - DNA, 519 bp, Homo sapiens
  misc_feature: HIJSMM301C2M3F.43.45.E01.1.454.light.4.raw
tgtgagtagtcacgaccggtgctcgatttagtgagtcagtaagggaaaggggctgggcctgaggaagcagcactggtggtgcctcagccatggcctggaccgttctcctcctcggcctcctctctcactgcacaggctccgtgacctcctatgaactgactcagccccctcggtgtctgtggccccaggacagacggccagcattacctgtgggggatacaactttgcccagaaaaatgtacattggtatcagcagaaggcaggccaggcccctgtgatggtcgtctgtgacgatagggaccggccctcggggatccttgagcgattctctggctccaagtctggcaacacggccaccctggccatcagcagggtcgaagccggggatgaggccgactattactgtcaggtgtgggataatggtggtgatcatccggtcttcggcggagggaccaagttgaccgtcctaagtcagcccaaggctgccccctcggtcactctgttcccacctcctcacta

SEQ ID NO: 558306 - DNA, 493 bp, Homo sapiens
  misc_feature: HIJSMM301DTCQ7.49.66.F11.1.454.light.4.raw
agtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccagccaggttcagtggcagtgggtttggggcagacttcacgctcaccatcagcagcctagagcctgaagattttgcagtttattactgtcaacagcgtaccacaggattcactttcggccctgggaccagagtggatatcaaacgaactgtggctgcaccatctgtcttcatcttcccg

SEQ ID NO: 558307 - DNA, 493 bp, Homo sapiens; identical to SEQ ID NO: 536969
  misc_feature: HIJSMM301D5T6X.27.78.H01.1.454.light.4.raw

SEQ ID NO: 558308 - DNA, 512 bp, Homo sapiens
  misc_feature: HIJSMM301AJMR8.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcgtccgaacgggaaccgaaggaggtaaagtacaaacgaactagtggctgcaccactctgtcttctatcttccccg

SEQ ID NO: 558309 - DNA, 505 bp, Homo sapiens; identical to SEQ ID NO: 538422
  misc_feature: HIJSMM301AW1JR.19.78.H01.1.454.light.4.raw

SEQ ID NO: 558310 - DNA, 500 bp, Homo sapiens; identical to SEQ ID NO: 541228
  misc_feature: HIJSMM301CU3J4.13.11.A11.1.454.light.4.raw

SEQ ID NO: 558311 - DNA, 494 bp, Homo sapiens; identical to SEQ ID NO: 541183
  misc_feature: HIJSMM301BKRH7.19.71.G05.1.454.light.4.raw

SEQ ID NO: 558312 - DNA, 494 bp, Homo sapiens; identical to SEQ ID NO: 534994
  misc_feature: HIJSMM301EPLY9.27.78.H01.1.454.light.4.raw

SEQ ID NO: 558313 - DNA, 479 bp, Homo sapiens; identical to SEQ ID NO: 541538
  misc_feature: HIJSMM301ALQQR.48.51.E07.1.454.light.4.raw

SEQ ID NO: 558314 - DNA, 487 bp, Homo sapiens; identical to SEQ ID NO: 535069
  misc_feature: HIJSMM301AUUC5.26.23.C01.1.454.light.4.raw

SEQ ID NO: 558315 - DNA, 445 bp, Homo sapiens; identical to SEQ ID NO: 537719
  misc_feature: HIJSMM301CBPJE.47.85.H08.1.454.light.4.raw

SEQ ID NO: 558316 - DNA, 513 bp, Homo sapiens
  misc_feature: HIJSMM301BS5BT.49.34.D01.1.454.light.4.raw
agtcgagagacacgaccggtgctcgatttagatcgtctgtgttgggtttgggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgccaaaaagatatgcttattggtaccatcagaagtcaggccaggcccctgtactggtcatctatgaggacaccaaacgaccctccgggatccctacgagattctctggctccagtttagggacagtggccaccctgacagtcagtggggcccaggtggaggatgagggtgattactactgttactcaacagacattactactactcatagggtgttcggcggagggaccaagctgaccgtcctaggtcagcccaacggctgccccctcggtcactctgttcccaccct

SEQ ID NO: 558317 - DNA, 487 bp, Homo sapiens
  misc_feature: HIJSMM301D9IO2.7.85.H08.1.454.light.4.raw
cgtgtctctacacgaccggtgctcgatttagtatcactcagtcgcggggtccaaacagagcttcagcaaacatagtgggaatctgcaccatgccctgggctctgctcctcctgaccctcctcactcactctgcagtgtcagtggtccaggcagggctgactcagccaccctcggtgtccaagggcctgcgacagaccgcaacactcacctgcactgggagcagcaacgatgttggcagggagggagcagcttggctgcagcaacacgagggccaccctcccaaactcctctcctacaggaataacgagcggccctcagggatctcagagagattctctgcatccaggtcaggaaacacagcctccctgaccattactggactccagcctgaggacgaggctgactattactgctcagcatgggacagcggcctcaggacttatgtcttcggaactgggacccacgttaccgtcctaggtcagacccg

SEQ ID NO: 558318 - DNA, 515 bp, Homo sapiens
  misc_feature: HIJSMM301CFKBJ.22.36.D03.1.454.light.4.raw
acatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaaccccccaactcatcatttatggtgtcactcgtcggccctcaggagtctctcatcgcttctcaggctccaagtctggcaacacggcctccctaaccatctctgggctccagtttgaggacgagtctacttattactgcagttcctttaaattaggtcgccactctcgtggttttcggtcggaggcaccgaagtgaccgtcctcggtcagcccaagctcgccccctccggtcact

SEQ ID NO: 558319 - DNA, 513 bp, Homo sapiens; identical to SEQ ID NO: 549395
  misc_feature: HIJSMM301CWRWB.17.33.C11.1.454.light.4.raw

SEQ ID NO: 558320 - DNA, 486 bp, Homo sapiens; identical to SEQ ID NO: 535385
  misc_feature: HIJSMM301CDE36.19.71.G05.1.454.light.4.raw

SEQ ID NO: 558321 - DNA, 496 bp, Homo sapiens; identical to SEQ ID NO: 537925
  misc_feature: HIJSMM301BSDN2.22.14.B03.1.454.light.4.raw

SEQ ID NO: 558322 - DNA, 447 bp, Homo sapiens; identical to SEQ ID NO: 535201
  misc_feature: HIJSMM301DCQMB.18.9.A09.1.454.light.4.raw

SEQ ID NO: 558323 - DNA, 494 bp, Homo sapiens; identical to SEQ ID NO: 534994
  misc_feature: HIJSMM301DM72O.27.78.H01.1.454.light.4.raw

SEQ ID NO: 558324 - DNA, 494 bp, Homo sapiens
  misc_feature: HIJSMM301BSHMQ.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaagggaccaaagtaggacgatcaagcgaactagtggctgcaccatctgtt

SEQ ID NO: 558325 - DNA, 454 bp, Homo sapiens; identical to SEQ ID NO: 535005
  misc_feature: HIJSMM301AIGIF.19.86.H09.1.454.light.4.raw

SEQ ID NO: 558326 - DNA, 491 bp, Homo sapiens
  misc_feature: HIJSMM301CHMP3.48.71.G05.1.454.light.4.raw
agtatacatacacgaccggtgctcgatttagtgtcgtcgcaagagagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccaggctcctcatctatggtgcgtccaccagggccactggcatcccagacaggttcagtggcagtgggtctgggacagacttcactctcaccatcaccagactggagcctgatgattttgcagtgttttctgtcagcagtatggaagttcacctcggacattcggccaggggaccaaggtggaaatcaaacgaactgtggctgcaccatctgtcttcatcttccgccatctgatatgtatact

SEQ ID NO: 558327 - DNA, 495 bp, Homo sapiens; identical to SEQ ID NO: 537273
  misc_feature: HIJSMM301DXC8A.15.26.C04.1.454.light.4.raw

SEQ ID NO: 558328 - DNA, 488 bp, Homo sapiens; identical to SEQ ID NO: 535081
  misc_feature: HIJSMM301AQD2X.26.23.C01.1.454.light.4.raw

SEQ ID NO: 558329 - DNA, 488 bp, Homo sapiens; identical to SEQ ID NO: 535990
  misc_feature: HIJSMM301BV6UN.11.28.C06.1.454.light.4.raw

SEQ ID NO: 558330 - DNA, 494 bp, Homo sapiens; identical to SEQ ID NO: 534994
  misc_feature: HIJSMM301BM48U.27.78.H01.1.454.light.4.raw

SEQ ID NO: 558331 - DNA, 494 bp, Homo sapiens; identical to SEQ ID NO: 534992
  misc_feature: HIJSMM301BZ1VQ.9.1.A01.1.454.light.4.raw

SEQ ID NO: 558332 - DNA, 506 bp, Homo sapiens
  misc_feature: HIJSMM301A0WME.8.71.G05.1.454.light.4.raw
ctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccagggaaagcccctaaatacctggtctatactgcatccactttgcaaagtggggtcccatcaaggttcagtggcagtggatttgggacagttttcactctcacaatcagcagtctcgaacctgaagattttgcaacttactactgtcaacagacttacaatataccgaggacgttcggtcaagggaccaaggtggagatcaaacgaactgtggctgcaccatctgtcttcatttcctcccgact

SEQ ID NO: 558333 - DNA, 470 bp, Homo sapiens
  misc_feature: HIJSMM301CQS1F.5.34.D01.1.454.light.4.raw
atcagacacgcacgaccggtgctcgatttagatcgtctgtgttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtgggtcccatcaaggttcagcggcagtggatctgggacagatttcactctcaccatcagcagcctgcagcctgaagattttgcaacttactattgtcaacaggctaacagtttccctccgaccttcggccaaggacacgactggagattaacgaa

SEQ ID NO: 558334 - DNA, 464 bp, Homo sapiens; identical to SEQ ID NO: 543670
  misc_feature: HIJSMM301EUKN2.51.16.B05.1.454.light.4.raw

SEQ ID NO: 558335 - DNA, 503 bp, Homo sapiens; identical to SEQ ID NO: 536834
  misc_feature: HIJSMM301EP7HN.2.35.D02.1.454.light.4.raw

SEQ ID NO: 558336 - DNA, 480 bp, Homo sapiens
  misc_feature: HIJSMM301DMRK1.48.38.D05.1.454.light.4.raw
agtatacatacacgaccggtgctcgatttagtatctgatagttgggtttgggggcagctcaggaagcagagcctggagcatctccactatggcctgggctccactacttctcaccctcctcgctcactgcacaggttcttgggcccattttatgctgactcagccccactctgtgtcggagtctccggggaagacggtgaccatctcctgcacccgcagcagtggcagcgttgccaccaactatgtgcagtggttccagcagcgcccgggcagttcgcccatcactgtgatctatgagaataatgagagaccctctggggtccccgatcggttctctggctccatcgacaggtcctccaactctgcctctctcaccatctctggactgcagactgaggacgaggctgattactactgtcagtcttatgatagtggcaataatgtttgggtgtttggcggagggaccaagctgaccgtcct

SEQ ID NO: 558337 - DNA, 487 bp, Homo sapiens; identical to SEQ ID NO: 536206
  misc_feature: HIJSMM301CP00H.47.38.D05.1.454.light.4.raw

SEQ ID NO: 558338 - DNA, 470 bp, Homo sapiens
  misc_feature: HIJSMM301CT6WT.51.38.D05.1.454.light.4.raw
cgatcgtatacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagagaccagggaaagcccctaacctcctgatctatgatgcatccaatttgaaagtgggtcccatcaaggttcagtggcagtggatctgggacagatttcactctcaccatcagcagtgtgcgacctgaagattttgcaacttactactgtcaacagagttacagtacccctcagctcactttcggcggagggaccaaggtggagatcaaacgaa

SEQ ID NO: 558339 - DNA, 478 bp, Homo sapiens; identical to SEQ ID NO: 535129
  misc_feature: HIJSMM301DR84Y.11.11.A11.1.454.light.4.raw

SEQ ID NO: 558340 - DNA, 441 bp, Homo sapiens; identical to SEQ ID NO: 534971
  misc_feature: HIJSMM301DBWW1.11.3.A03.1.454.light.4.raw

SEQ ID NO: 558341 - DNA, 521 bp, Homo sapiens; identical to SEQ ID NO: 538715
  misc_feature: HIJSMM301EMATM.27.23.C01.1.454.light.4.raw

SEQ ID NO: 558342 - DNA, 464 bp, Homo sapiens
  misc_feature: HIJSMM301BZLTP.41.42.D09.1.454.light.4.raw
tctatactatcacgaccggtgctcgatttagacacatacgcagggaaagggggaggaactgctcagttaggacccagacggaaccatggaagccccagcgcagcttctcttcctcctgctactctggctcccaggggaaagagccaccctctcctgcagggccagtcagagtcttagcggcaccttagcctggtaccagcagaaacctggccaggctcccaggctcctcatctatggtacatccaccagggtcactggtgttccagccaggttcagtggcagtgggtccgggacagagttcactctcaccatcagcagcctgcagtctgaagattttgcaatttattactgtcaccagtatggtagttcacctctaactttcggcggagggaccaaggtggaggatcaaacgaactgtggctgcaccatctgtcttcatcttcccgccatctgaatagtataga

SEQ ID NO: 558343 - DNA, 465 bp, Homo sapiens; identical to SEQ ID NO: 549885
  misc_feature: HIJSMM301DQFRY.11.70.G04.1.454.light.4.raw

SEQ ID NO: 558344 - DNA, 522 bp, Homo sapiens
  misc_feature: HIJSMM301BPYKX.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggtccaacggaccgaaggtaggaaggtcgaaacgaaccgtagtggcgtgcaccatctgtcttctatcttcccgtcccactctgat

SEQ ID NO: 558345 - DNA, 504 bp, Homo sapiens; identical to SEQ ID NO: 538940
  misc_feature: HIJSMM301A71L7.2.35.D02.1.454.light.4.raw

SEQ ID NO: 558346 - DNA, 494 bp, Homo sapiens; identical to SEQ ID NO: 534994
  misc_feature: HIJSMM301BDJMY.27.78.H01.1.454.light.4.raw

SEQ ID NO: 558347 - DNA, 497 bp, Homo sapiens; identical to SEQ ID NO: 536371
  misc_feature: HIJSMM301COF7B.16.78.H01.1.454.light.4.raw

SEQ ID NO: 558348 - DNA, 382 bp, Homo sapiens
  misc_feature: HIJSMM301DSIEI.48.26.C04.1.454.light.4.raw
agtatacatacacgaccggtgctcgatttagtctagcgactttgggtttgggggctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcacca

SEQ ID NO: 558349 - DNA, 473 bp, Homo sapiens; identical to SEQ ID NO: 535262
  misc_feature: HIJSMM301CDDJN.8.67.G01.1.454.light.4.raw

SEQ ID NO: 558350 - DNA, 484 bp, Homo sapiens
  misc_feature: HIJSMM301BRX3E.51.73.G07.1.454.light.4.raw
cgatcgtatacacgaccggtgctcgatttagctctacgctcagggcacgaccggtgctcgatttagcgagacgcgcaggggactgcgggggtaagaggttgtgtccaccatggcctggactcctctcctcctcctgttcctctctcactgcacaggttccctctcgcaggctgtgctgactcagccgtcttccctgtctgcatctcctggagcatcagccagtctcacctgcaccttgcgcagtggcttcgatgttagtacctacaggatatactggttccagcagaaggcagggagtcctccccagtttctcctaaattacaaatctgactcacgtaagcagcagggctctggagtccccagccgcttctctggatccaaagatgcttcggccaatgcggggattttactcatctctgggctccagtctgaggatgaggctgactattactgtttgatttggcacagcagcgcttgggtattc

SEQ ID NO: 558351 - DNA, 511 bp, Homo sapiens; identical to SEQ ID NO: 535406
  misc_feature: HIJSMM301CKAGT.43.59.F04.1.454.light.4.raw

SEQ ID NO: 558352 - DNA, 484 bp, Homo sapiens; identical to SEQ ID NO: 552176
  misc_feature: HIJSMM301BQTSU.40.83.H06.1.454.light.4.raw

SEQ ID NO: 558353 - DNA, 491 bp, Homo sapiens
  misc_feature: HIJSMM301A27WI.11.12.B01.1.454.light.4.raw
cgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccccctgtcctactcatctttcaaaataccaggcggccctctggggtccctgagcgattctccggctccggctctgggaacacagtcactctgaccatcagcgggacccaggctattgatgaggctgtctacttctgtcaggcgtgggacaacagcgtggtgttcggcggagggaccagtctgaccgtcttaggtcagcccaaggctgccccctcggtcactcc

SEQ ID NO: 558354 - DNA, 515 bp, Homo sapiens; identical to SEQ ID NO: 536247
  misc_feature: HIJSMM301A1SDP.14.19.B08.1.454.light.4.raw

SEQ ID NO: 558355 - DNA, 495 bp, Homo sapiens; identical to SEQ ID NO: 535821
  misc_feature: HIJSMM301DPSO6.3.31.C09.1.454.light.4.raw

SEQ ID NO: 558356 - DNA, 513 bp, Homo sapiens
  misc_feature: HIJSMM301E3AF6.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccaatcaatagcctggaagctgaagatgctgcaacttattactgtcatcagagtactactttaccttacaacgtagatcaccttcggtccaacggaacgacgactagaggaattaaacg

SEQ ID NO: 558357 - DNA, 504 bp, Homo sapiens
  misc_feature: HIJSMM301B32EZ.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgtggggtttattactgcatgcaaactacacacggccgctcactttcggcggagggaccaaggtggagatcaaacgaactgtggctgcaccatctgt

SEQ ID NO: 558358 - DNA, 501 bp, Homo sapiens
  misc_feature: HIJSMM301AE26Z.10.20.B09.1.454.light.4.raw
  modified_base (435)..(435): a, c, t, g, unknown or other
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagcggcctgcagtctgaagaattttgtcagtttattactgtcagcagtataatagtactgggtttagtttntacttcgtccgtcggcgaacgtagagtagtatagaacgtactaggtcgtgtgacacactctcttct

SEQ ID NO: 558359 - DNA, 518 bp, Homo sapiens
  misc_feature: HIJSMM301EKHF2.27.23.C01.1.454.light.4.raw
agcgtcgtctcacgaccggtgctcgatttagtacacgtgattagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggctccctgaccatctccgggctccagcctgaggacgaggctgattattattgtagttcatatacaaccagtgacacttgggtgttcggcggagggaccaggctgaccgtcctaggtcagccaaggctgccccctggtcactctgttcccacct

SEQ ID NO: 558360 - DNA, 488 bp, Homo sapiens; identical to SEQ ID NO: 551155
  misc_feature: HIJSMM301BJZAU.3.33.C11.1.454.light.4.raw

SEQ ID NO: 558361 - DNA, 485 bp, Homo sapiens; identical to SEQ ID NO: 535606
  misc_feature: HIJSMM301BQVC1.47.46.E02.1.454.light.4.raw

SEQ ID NO: 558362 - DNA, 521 bp, Homo sapiens; identical to SEQ ID NO: 539470
  misc_feature: HIJSMM301EK2JL.27.23.C01.1.454.light.4.raw

SEQ ID NO: 558363 - DNA, 508 bp, Homo sapiens
  misc_feature: HIJSMM301A6S0S.10.9.A09.1.454.light.4.raw
catagtagtgcacgaccggtgctcgatttagcgagacgcgcaggggcagagccctggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagagccaccctctcctgcagggccagtcagaatgttggcgccttcgtaagctggtaccaacacaaacctggccaggctcccgggcccctcatctatggtgcatccaacagggccactggcatcccagccaggttcagtggcagtgggtatgggacagacttcactctcaccatcatcagcctggagcctgaagatgttgctagtttattactgtcaacatcgtaccgagtggccgtccgggggccacgtttccggcccgtgggaccaaagtggagatacaaacgaactgtggctgcacc

SEQ ID NO: 558364 - DNA, 482 bp, Homo sapiens
  misc_feature: HIJSMM301EFB6P.48.42.D09.1.454.light.4.raw
agtatacatacacgaccggtgctcgatttagacacatacgcagggaaaggggctgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcctcgggcgttcggcaaggaccaaggtaggaatacaacgaa

SEQ ID NO: 558365 - DNA, 512 bp, Homo sapiens; identical to SEQ ID NO: 539813
  misc_feature: HIJSMM301EGPV8.14.7.A07.1.454.light.4.raw

SEQ ID NO: 558366 - DNA, 508 bp, Homo sapiens
  misc_feature: HIJSMM301DV228.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcggccgaaggaccgaaggtaggaaatacaaacgaactagtggctgcaccactctgtcttcatcttccccg

SEQ ID NO: 558367 - DNA, 499 bp, Homo sapiens
  misc_feature: HIJSMM301C434C.7.5.A05.1.454.light.4.raw
cgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggtttccgtaatcgcttctctggctccaagtctggcggacacggcctccctgaccatctctgggctccaggctgaagacgaggctgattattactgcagctcatatacaggcagcagcactcaggttttcgggcggagggaccaagctgaccgtcctaggtcagccaaggctgccccctcggt

SEQ ID NO: 558368 - DNA, 473 bp, Homo sapiens
  misc_feature: HIJSMM301DT0KV.51.78.H01.1.454.light.4.raw
cgatcgtatacacgaccggtgctcgatttagtgtgagtagtttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagagaccagggaaagcccctaacctcctgatctatgatgcatccaatttggaaagtggggtcccatcaaggttcagtggcagtggatctgggacagatttcactctcaccatcagcagtgtgcgacctgaagattttgcaacttactactgtcaacagagttacagtacccctcagctcactttcggcggagggaccgaaggtggagatcaaacgaa

SEQ ID NO: 558369 - DNA, 517 bp, Homo sapiens
  misc_feature: HIJSMM301CAA9B.14.19.B08.1.454.light.4.raw
cgtctagtaccacgaccggtgctcgatttagtgagtcagtaaggggagagaagacaggattcaggacaatctccagcatggcccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaacggcccccaaactcctcatctataggaataatcagcggccctcaggggtccctgaccgattctctggctccaaggctggcacctcagcctccctggccatcagtgggctccggtccgaggatgaggctgattattactgtgcagcatgggatgacagcctgagtggtcttgggtgttcggcggagggaccaagctgaccgtcctaagtcagcccaaggctcgccccctcggtcactctcgttcccaccctcctcg

SEQ ID NO: 558370 - DNA, 493 bp, Homo sapiens
  misc_feature: HIJSMM301B2UTC.48.71.G05.1.454.light.4.raw
agtatacatacacgaccggtgctcgatttagtgtcgtcgcaagagagaggggaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccaggctcctcatctatggtgcgtccaccagggccactggcatcccagacaggttcagtgacagtgggtctgggacagacttcactctcaccatcaccagactggagcctgatgattttgcagtgtttttctgtcagcagtatggaagttcacctcggacattcggccaggggaccaaggtggaaatcaaacgaactgtggctgcaccatctgtcttcatcttcccgccatctgatatgtatact

SEQ ID NO: 558371 - DNA, 503 bp, Homo sapiens
  misc_feature: HIJSMM301AJYUX.12.67.G01.1.454.light.4.raw
atacgacgtacacgaccggtgctcgatttagagtatacatattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcagagcccccaaactcatgatttttgatgtcactaatcggccctcaggggtttctgatcgcttctctggctccaagtctgactacacggcctccctgaccatctctgggctccaggctgaggacgaggctgattattattgcagctcatatacaagcagcagcaccctctttgtcttcggaagtgggaccaaggtcaccgtcctacgtcagcccaaggccaacccca

SEQ ID NO: 558372 - DNA, 510 bp, Homo sapiens
  misc_feature: HIJSMM301EX2Y8.9.33.C11.1.454.light.4.raw
tgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaaattgagatcaaacgaactagtggctgcaccatctgtcttcatcttcccg

SEQ ID NO: 558373 - DNA, 482 bp, Homo sapiens; identical to SEQ ID NO: 552591
  misc_feature: HIJSMM301C3XJD.48.22.B11.1.454.light.4.raw

SEQ ID NO: 558374 - DNA, 494 bp, Homo sapiens; identical to SEQ ID NO: 534994
  misc_feature: HIJSMM301BRSPR.27.78.H01.1.454.light.4.raw

SEQ ID NO: 558375 - DNA, 473 bp, Homo sapiens; identical to SEQ ID NO: 541215
  misc_feature: HIJSMM301CRDSH.13.48.E04.1.454.light.4.raw

SEQ ID NO: 558376 - DNA, 482 bp, Homo sapiens; identical to SEQ ID NO: 535216
  misc_feature: HIJSMM301C8BEF.17.26.C04.1.454.light.4.raw

SEQ ID NO: 558377 - DNA, 498 bp, Homo sapiens
  misc_feature: HIJSMM301D3AE2.11.21.B10.1.454.light.4.raw
cgagagataccacgaccggtgctcgatttagtgtcgtcgcaaggagagggggaggaactgctcagttaggacccagagggaaccatggaagccccagctcagcttctcttcctcctgctactctggctcccagatagcaccggagaaattgtgttgacacagtctccagccaccctgtctttgtctccaggggaaagagccaccctctcctgcagggccagtcagagtgttaacagctacttagcctggtaccaacagaaacctggccagactcccaggctcctcatctatgatgcatccaacagggccactggcaccccagccaggttcagtggcagtgggtctgggacagacttcactctcaccatcagcagcctagagcctgaggattttgcagtttattactgtcagcagcgtatcgactggatcacttcggccaagggacacgactggaaattaaacgaactgtggctgcaccatctgtcttcatcttccccg

SEQ ID NO: 558378 - DNA, 504 bp, Homo sapiens; identical to SEQ ID NO: 535561
  misc_feature: HIJSMM301DWYRY.4.57.F02.1.454.light.4.raw

SEQ ID NO: 558379 - DNA, 496 bp, Homo sapiens
  misc_feature: HIJSMM301ANM2C.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttacacttttggccagggaccaagctggagatacaaacgaactgtggtcg

SEQ ID NO: 558380 - DNA, 518 bp, Homo sapiens; identical to SEQ ID NO: 536231
  misc_feature: HIJSMM301BK5UX.22.30.C08.1.454.light.4.raw

SEQ ID NO: 558381 - DNA, 498 bp, Homo sapiens; identical to SEQ ID NO: 554282
  misc_feature: HIJSMM301CKMJ8.9.27.C05.1.454.light.4.raw

SEQ ID NO: 558382 - DNA, 497 bp, Homo sapiens
  misc_feature: HIJSMM301CVQVX.53.81.H04.1.454.light.4.raw
cgcgtatacacacgaccggtgctcgatttagtagtgtagattcgcggggtcagcttcagctgtggtagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcctgttctggaagcaggtccaacatcggaagtgattttgtattctggtaccagctgctcccaggagcgggccccaaactcctcatttacaggaatgatcagcggccctcaggggtccctgaccgattctctggctccaagtctggcacctcagcctccctggccatcagtggcctccggtccgacgatgaggctgattattattgtgcagcatgggatgacagcctgagtggtgtggtattcggcggagggaccaagctgaccgtcctaggtcagcccaagg

SEQ ID NO: 558383 - DNA, 499 bp, Homo sapiens; identical to SEQ ID NO: 545732
  misc_feature: HIJSMM301EB4UT.3.33.C11.1.454.light.4.raw

SEQ ID NO: 558384 - DNA, 486 bp, Homo sapiens; identical to SEQ ID NO: 535043
  misc_feature: HIJSMM301AFGGQ.46.35.D02.1.454.light.4.raw

SEQ ID NO: 558385 - DNA, 494 bp, Homo sapiens; identical to SEQ ID NO: 536444
  misc_feature: HIJSMM301D03CN.26.72.G06.1.454.light.4.raw

SEQ ID NO: 558386 - DNA, 491 bp, Homo sapiens; identical to SEQ ID NO: 535294
  misc_feature: HIJSMM301BU8FX.16.68.G02.1.454.light.4.raw

SEQ ID NO: 558387 - DNA, 502 bp, Homo sapiens
  misc_feature: HIJSMM301BRSGC.43.86.H09.1.454.light.4.raw
tgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgcctaatttataaggtttctaaccgggactctggggtcccagacagattcagcggcagtgggtctggcactgatttcacactgacaatcagcagggtggaggctgaggatgttgggttttattactgcatgcaaacttcacactggcctccgttcacttttggccaggggaccaaggtggagatcaaacgaactgtggctgcacc

SEQ ID NO: 558388 - DNA, 484 bp, Homo sapiens; identical to SEQ ID NO: 535998
  misc_feature: HIJSMM301BZY23.3.10.A10.1.454.light.4.raw

SEQ ID NO: 558389 - DNA, 512 bp, Homo sapiens; identical to SEQ ID NO: 548157
  misc_feature: HIJSMM301A0TBP.17.33.C11.1.454.light.4.raw

SEQ ID NO: 558390 - DNA, 522 bp, Homo sapiens; identical to SEQ ID NO: 543470
  misc_feature: HIJSMM301BW50K.5.27.C05.1.454.light.4.raw

SEQ ID NO: 558391 - DNA, 496 bp, Homo sapiens; identical to SEQ ID NO: 558251
  misc_feature: HIJSMM301DLG5P.16.78.H01.1.454.light.4.raw

SEQ ID NO: 558392 - DNA, 488 bp, Homo sapiens
  misc_feature: HIJSMM301BCK1I.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgactgacaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaa

SEQ ID NO: 558393 - DNA, 497 bp, Homo sapiens; identical to SEQ ID NO: 535740
  misc_feature: HIJSMM301A7XLQ.3.71.G05.1.454.light.4.raw

SEQ ID NO: 558394 - DNA, 521 bp, Homo sapiens; identical to SEQ ID NO: 539470
  misc_feature: HIJSMM301ARUGJ.27.23.C01.1.454.light.4.raw

SEQ ID NO: 558395 - DNA, 495 bp, Homo sapiens; identical to SEQ ID NO: 538269
  misc_feature: HIJSMM301EMUO6.9.1.A01.1.454.light.4.raw

SEQ ID NO: 558396 - DNA, 467 bp, Homo sapiens
  misc_feature: HIJSMM301AJKVO.3.20.B09.1.454.light.4.raw
agacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcgtctatttaaattggtatcagcacaaaccagggaaagcccctaagctcctgatctatgctgaatccactttgcaaagtggggtcccatcaaggttcagtggcagtggatctgggacagatttcactctaaccatcagcggtctgcaacctgaagattttgcaactcactactgtcaacagagtgacagcacgcctcacactttcggcggagggaccgaaggtggagatcaaacgaa

SEQ ID NO: 558397 - DNA, 497 bp, Homo sapiens
  misc_feature: HIJSMM301D55BZ.13.42.D09.1.454.light.4.raw
tcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctcggacgtcgtccgaggaccgaaggtaggaagtacaaacgaactagtggcgtgcgaccactctcgtt

SEQ ID NO: 558398 - DNA, 479 bp, Homo sapiens; identical to SEQ ID NO: 538204
  misc_feature: HIJSMM301EKDVX.51.60.F05.1.454.light.4.raw

SEQ ID NO: 558399 - DNA, 486 bp, Homo sapiens; identical to SEQ ID NO: 535385
  misc_feature: HIJSMM301A1YRG.19.71.G05.1.454.light.4.raw

SEQ ID NO: 558400 - DNA, 490 bp, Homo sapiens; identical to SEQ ID NO: 535234
  misc_feature: HIJSMM301DH3RI.17.21.B10.1.454.light.4.raw

SEQ ID NO: 558401 - DNA, 475 bp, Homo sapiens
  misc_feature: HIJSMM301DBWE8.49.53.E09.1.454.light.4.raw
agtcgagagacacgaccggtgctcgatttagagagagtgtgttgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccaggggaagagccaccctctcctgcagggccagtcagagtgttagcagcaacttagcctggtaccagcagaaacctggccaggctcccaggctcctcatctatgatacatccaacagggccactggcatcccagccaggttcagtggcagtgggtctgggacagacttcactctcaccatcagcagcctagagcctgaagattttgcagtctattactgtcagcagcgttacaactggcctcccatgtacacttttggccagggaccaagctggaaatcagacgaa

SEQ ID NO: 558402 - DNA, 505 bp, Homo sapiens
  misc_feature: HIJSMM301ALJIO.19.71.G05.1.454.light.4.raw
tactctcgtgcacgaccggtgctcgatttagtgtcgtcgcaagagagagggggggtacaacaggcaggcaggggcagcaagatggtgttgcagacccaggtcttcatttctctgttgctctggatctcgtggtcgcccgacggggacatcgtgatcgacccagtcctccagacctcccgtggctgtgtctcgtgggcgaggcgggccaccagtcgaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacttcggccaagggaccaaggtggatatcagacgaactgtggctgca

SEQ ID NO: 558403 - DNA, 496 bp, Homo sapiens
  misc_feature: HIJSMM301AG074.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggcgggggccgaacggtggagttcaacgaactagtggctgcaccactctgtcttctat

SEQ ID NO: 558404 - DNA, 510 bp, Homo sapiens
  misc_feature: HIJSMM301BM95L.5.59.F04.1.454.light.4.raw
atcagacacgcacgaccggtgctcgatttagtacacacacttagggattggggaagagctgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctgggacagacttcactctcaccatcagcagactggagcctgaagattttgcagtgtattactgtcagcagtatggtagctcacggacgttcggccaaggaccgaaggtggaaagtacaaacgaactagtggcgtgcaccactctgtcttctactcttccccg

SEQ ID NO: 558405 - DNA, 441 bp, Homo sapiens; identical to SEQ ID NO: 550529
  misc_feature: HIJSMM301DD0G8.41.9.A09.1.454.light.4.raw

SEQ ID NO: 558406 - DNA, 489 bp, Homo sapiens
  misc_feature: HIJSMM301EQ1AW.19.15.B04.1.454.light.4.raw
tactctcgtgcacgaccggtgctcgatttagacagtatatatccgcgggggagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagagccaccctctcctgcagctccagccagaatatccagagctactacatagcctggtaccagcagaagcctggccaggctcccaggttcctcatctatgctgggtcccacagggccactggcatcccagacaggttcagtggcagtgggtctgggacagacttcactctcatcattagcagactggagcctgaagatttcgcagtgtattactgtcagcagtatggaagttcacctctgtcgttcggccaagggaccaaggtagaaatgaaacgaactgtggctgcaccat

SEQ ID NO: 558407 - DNA, 493 bp, Homo sapiens
  misc_feature: HIJSMM301ASQUO.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagttttattactgtcagcaatactatagtcctcctctcacgttcggcggagggaccaaggtggagatcaaacgaactgtggctgcaccatctgtcttcatcttcccgccat

SEQ ID NO: 558408 - DNA, 497 bp, Homo sapiens; identical to SEQ ID NO: 536376
  misc_feature: HIJSMM301A3I3P.22.9.A09.1.454.light.4.raw

SEQ ID NO: 558409 - DNA, 495 bp, Homo sapiens; identical to SEQ ID NO: 535596
  misc_feature: HIJSMM301D1B2E.10.79.H02.1.454.light.4.raw

SEQ ID NO: 558410 - DNA, 493 bp, Homo sapiens; identical to SEQ ID NO: 535047
  misc_feature: HIJSMM301EUVSK.16.53.E09.1.454.light.4.raw

SEQ ID NO: 558411 - DNA, 505 bp, Homo sapiens; identical to SEQ ID NO: 538224
  misc_feature: HIJSMM301ALZQJ.16.46.E02.1.454.light.4.raw

SEQ ID NO: 558412 - DNA, 494 bp, Homo sapiens
  misc_feature: HIJSMM301B4653.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgcccctcggtcactctgttcccacctcctcgagtgcgtct

SEQ ID NO: 558413 - DNA, 501 bp, Homo sapiens
  misc_feature: HIJSMM301ADMIT.15.1.A01.1.454.light.4.raw
  modified_base (408)..(408): a, c, t, g, unknown or other
  modified_base (470)..(470): a, c, t, g, unknown or other
  modified_base (497)..(497): a, c, t, g, unknown or other
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccacccggcagagcccccaaactcatgatttatgaggccactaagcgaccctcagggctttctaatcgcttctctggctccaagtctggcaacacggcctccctgacaatctctgggctccaggctgacgacgaggctaattattacngctgctcatatgaaggttataacactatactattcggcggagggaccaagctgaccgtcctncgtcagcccaaggctgccccctcggtnactc

SEQ ID NO: 558414 - DNA, 495 bp, Homo sapiens; identical to SEQ ID NO: 536359
  misc_feature: HIJSMM301CLR8F.48.4.A04.1.454.light.4.raw

SEQ ID NO: 558415 - DNA, 495 bp, Homo sapiens; identical to SEQ ID NO: 535596
  misc_feature: HIJSMM301AXPLP.10.79.H02.1.454.light.4.raw

SEQ ID NO: 558416 - DNA, 485 bp, Homo sapiens
  misc_feature: HIJSMM301DWU0I.14.53.E09.1.454.light.4.raw
cgtctagtaccacgaccggtgctcgatttagagagagtgtgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgctttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttatcgggtgttcggcggaggaccaagctgaccgtcctaggtcagcccaaggctcgccccctcggtcta

SEQ ID NO: 558417 - DNA, 504 bp, Homo sapiens
  misc_feature: HIJSMM301AWPIS.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaggaccaaggtggaagtcaagcgaactgtggctgcaccatctgtcttcatctccgcc

SEQ ID NO: 558418 - DNA, 497 bp, Homo sapiens
  misc_feature: HIJSMM301AXFVK.16.12.B01.1.454.light.4.raw
tgtactactccacgaccggtgctcgatttagtagtgtagattccgcggggctgggcctcaggaagcagcatcggaggtgcctcagccatggcatggatccctctcttcctcggcgtccttgcttactgcacagtatcggtggcctcctatcagttgactcagccaccctcagtgtccgtgtccccaggacagacggccagcatcatctgctctggagataacttgggggataaatatactttctggtatcagcagaaggccggccagtcccctgtattggtcatctttcaagataccgagcggccctcagagatccctgagcgattctctggctccaactctgggaacacagccacttctgaccatcagcggggcccagactatggatgaggctgactattactgtcaggcgtgggacagcaattctgtgattttcggcggagggaccaagttgaccgtcctaggtcagcccaaggctgccccctcggtcactctcg

SEQ ID NO: 558419 - DNA, 484 bp, Homo sapiens; identical to SEQ ID NO: 535441
  misc_feature: HIJSMM301DUVSW.26.60.F05.1.454.light.4.raw

SEQ ID NO: 558420 - DNA, 447 bp, Homo sapiens; identical to SEQ ID NO: 535201
  misc_feature: HIJSMM301A7T3K.18.9.A09.1.454.light.4.raw

SEQ ID NO: 558421 - DNA, 484 bp, Homo sapiens
  misc_feature: HIJSMM301BQFEN.7.76.G10.1.454.light.4.raw
cgtgtctctacacgaccggtgctcgatttagtcactcatacagggggcaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagcccctaaactcctgatctctgctgcatccagtttacaaagtggggtcccatcgcggttcagcggcagtggatatgggacatatttcactctcgccatcagcagcctgcagcctgaagattttgcaacttactattgtcaacaggctaacagtttcccgctcaccttcggcgggggaccgaacggtaggaggatacaaacgaaactgtggctgcacc

SEQ ID NO: 558422 - DNA, 490 bp, Homo sapiens
  misc_feature: HIJSMM301BAJL6.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttccctctcaccgtcagcagtctgcaacctgaagattttgcaacttactactgtcaacagagttacagtacccccctcactttcggcggagggaccaaggcggagatcagacgaactgtggctgcaccatctgtcttcatt

SEQ ID NO: 558423 - DNA, 495 bp, Homo sapiens
  misc_feature: HIJSMM301AUCT0.19.71.G05.1.454.light.4.raw
tactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatacgaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaactgtgg

SEQ ID NO: 558424 - DNA, 514 bp, Homo sapiens; identical to SEQ ID NO: 538885
  misc_feature: HIJSMM301BKR8Y.14.19.B08.1.454.light.4.raw

SEQ ID NO: 558425 - DNA, 383 bp, Homo sapiens; identical to SEQ ID NO: 447524
  misc_feature: HIJSMM301AHCED.41.26.C04.1.454.light.4.raw

SEQ ID NO: 558426 - DNA, 314 bp, Homo sapiens
  misc_feature: HIJSMM301COF98.10.86.H09.1.454.light.4.raw
catagtagtgcacgaccggtgctcgatttagtgctatagacttgggtttgggggctgtccccaaactcctcatctatgaagattttacgcgaccctcagggattcctggccgattctctggctccaagtcaggcacctctgccaccctggacatcaccgggctccagaccggggacgaggccgattattactgcgcaacttgggactccaacctgactgttggggctttcggcggagggactaagttgaccgtcctacgtcagcccaaggctgccccctcggtcactctgttcccgccctccttcactactatg

SEQ ID NO: 558427 - DNA, 495 bp, Homo sapiens; identical to SEQ ID NO: 538269
  misc_feature: HIJSMM301EGS6U.9.1.A01.1.454.light.4.raw

SEQ ID NO: 558428 - DNA, 499 bp, Homo sapiens; identical to SEQ ID NO: 537739
  misc_feature: HIJSMM301EQCC0.12.86.H09.1.454.light.4.raw

SEQ ID NO: 558429 - DNA, 514 bp, Homo sapiens
  misc_feature: HIJSMM301B01PZ.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggccgaacggaccgaacggtaggaagtacaaacgaactagtggcgtgcaccatctgtcttctatcttcccgtccact

SEQ ID NO: 558430 - DNA, 494 bp, Homo sapiens; identical to SEQ ID NO: 535828
  misc_feature: HIJSMM301BER1P.3.36.D03.1.454.light.4.raw

SEQ ID NO: 558431 - DNA, 493 bp, Homo sapiens; identical to SEQ ID NO: 535047
  misc_feature: HIJSMM301DMB70.16.53.E09.1.454.light.4.raw

SEQ ID NO: 558432 - DNA, 499 bp, Homo sapiens
  misc_feature: HIJSMM301CKZPD.19.78.H01.1.454.light.4.raw
tactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaaggtcaccgtcctagtcagcccaaggcaacccaac

SEQ ID NO: 558433 - DNA, 489 bp, Homo sapiens; identical to SEQ ID NO: 536013
  misc_feature: HIJSMM301EW1ID.26.23.C01.1.454.light.4.raw

SEQ ID NO: 558434 - DNA, 509 bp, Homo sapiens
  misc_feature: HIJSMM301B5GNR.40.67.G01.1.454.light.4.raw
tctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccagggccactggcgtcccggccaggttcagtggcagtgggtctgggacagccttcactctcaccatcagcagcctggagcccgaagattttgcggtttattactgtcagcagcgtgccgactggcccctcacgttcggcggagggaccaaggtggacatcaaacgaactgtggctgcaccatctgtcttcatcttcccgccattg

SEQ ID NO: 558435 - DNA, 446 bp, Homo sapiens
  misc_feature: HIJSMM301DRHT8.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtgttcgtatgtcttcggatctgggaccaaggtcaccgtcctaagtcagcccaaggccaacccctctgtcactctgttcccaccctcctccatactcgta

SEQ ID NO: 558436 - DNA, 501 bp, Homo sapiens
  misc_feature: HIJSMM301CJ4N7.14.3.A03.1.454.light.4.raw
cgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctggtaccaacagcacccaggcaaagtccccaaactcattatttatgaggtcaataatcggccctcaggagtttctaatcgcttctctggctccaagtctggcaacacggcctccctgagcatctctgggctccaggctgaggacgaggctgattattactgcagctcatatactattagcagaactgtggttttcggcggaggaccaaggtgaccgtctaggtcagccaaggctgcccctcggtcactctcg

SEQ ID NO: 558437 - DNA, 497 bp, Homo sapiens; identical to SEQ ID NO: 535286
  misc_feature: HIJSMM301BU48G.18.59.F04.1.454.light.4.raw

SEQ ID NO: 558438 - DNA, 507 bp, Homo sapiens
  misc_feature: HIJSMM301D4F3F.4.57.F02.1.454.light.4.raw
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtctttcggaactgggaccaaaggtctccgtcctacgtcagcccaacggccaactccactgtcact

SEQ ID NO: 558439 - DNA, 496 bp, Homo sapiens; identical to SEQ ID NO: 535660
  misc_feature: HIJSMM301BXNNO.43.25.C03.1.454.light.4.raw

SEQ ID NO: 558440 - DNA, 476 bp, Homo sapiens; identical to SEQ ID NO: 541603
  misc_feature: HIJSMM301B8COX.52.19.B08.1.454.light.4.raw

SEQ ID NO: 558441 - DNA, 490 bp, Homo sapiens
  misc_feature: HIJSMM301CVHTF.43.33.C11.1.454.light.4.raw
tgtgagtagtcacgaccggtgctcgatttagagtgagctcgttgggtttggggagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctcccccctacaatttcggtcaggggaccaagttgaacatcaatcgaactgtggctgcaccatctgt

SEQ ID NO: 558442 - DNA, 499 bp, Homo sapiens; identical to SEQ ID NO: 543887
  misc_feature: HIJSMM301BQEQM.10.65.F10.1.454.light.4.raw

SEQ ID NO: 558443 - DNA, 452 bp, Homo sapiens
  misc_feature: HIJSMM301AOZ60.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcgccctcctccacgagagta

SEQ ID NO: 558444 - DNA, 509 bp, Homo sapiens; identical to SEQ ID NO: 541829
  misc_feature: HIJSMM301AV2TF.17.28.C06.1.454.light.4.raw

SEQ ID NO: 558445 - DNA, 520 bp, Homo sapiens
  misc_feature: HIJSMM301BM4VE.40.87.H10.1.454.light.4.raw
tctagcgactcacgaccggtgctcgatttagcagtactgcgttgggtttgggggtagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatttcttgttctggaagcaactccaatatcggaactaattatgtatactggtaccagcagctcccaggaacggcccccaaagtcctcttctataggaataatcaacggccctcaggggtccctgaccgattctctgcctccaagtctggcacctctgtgtccctggccatcagtgggctccggtccgaagatgagggtgactattactgtgcagcttgggatgagagcctgagaggttggctgttcggcggagggaccaagctgaccgtcctaggtcagcccaaggctgccccctcggtcactctgttcccaccctcctc

SEQ ID NO: 558446 - DNA, 507 bp, Homo sapiens
  misc_feature: HIJSMM301DIQVD.3.79.H02.1.454.light.4.raw
agacgcactccacgaccggtgctcgatttagtgtcacacgaaggggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttatatctctgtctcctggtaccaacaacacccaggcaaagcccccaaactcatcatttatgatgtcactgctcggccctcaggggtttctcatcgcttttctggctccaagtctggcaccacggcctccctgaccatctcggggctccaggctgaggacgaggctgcttattactgcagctcatatacaaggagcaccactctcgtggtatttggtggagggaccaaggctgaccgtcctaggtcagcccaaggctgccccctggt

SEQ ID NO: 558447 - DNA, 513 bp, Homo sapiens
  misc_feature: HIJSMM301BWRZZ.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaacggcccccaaactcctcatctataggaataatcagcggccctcaggggtccctgaccgattctctggctccaaggctggcacctcagcctccctggccatcagtgggctccggtccgaggatgaggctgattattactgtgcagcatgggatgacagcctgagtggtccttgggtgttcggcggagggaccaagctgaccgtctaagtcagcccaaggctgccccctggtcactctgttcccaccctcctcg

SEQ ID NO: 558448 - DNA, 498 bp, Homo sapiens
  misc_feature: HIJSMM301ADF9N.43.33.C11.1.454.light.4.raw
tgtgagtagtcacgaccggtgctcgatttagagtgagctcgttgggtttgggggagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtctacccttttttgccgggcgagtcggcccattgacgactgtttggcctggtatcgcgtgagaccagggcaacctcctcaacttctgatataccgttcatcgctgttgcacggttggggtcccacctcggttcagtggcaacggctctgagacagtatttttctctcgtcatcactggtctacagtctgacgacggcgcaatgtacttctgtcaacactatgcctctcccccctactaactttcggtcgaggggaccaagttgaacatcaatcgaactgtggctgcaccatctgtt

SEQ ID NO: 558449 - DNA, 514 bp, Homo sapiens
  misc_feature: HIJSMM301D5SYV.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctacttactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtgttcggcggagggaccaagctggccgtcctaggtcagcccaaggctgccccctggtcactctgttccccaccctcctcgagtagtaca

SEQ ID NO: 558450 - DNA, 501 bp, Homo sapiens; identical to SEQ ID NO: 555551
  misc_feature: HIJSMM301EOPIT.21.81.H04.1.454.light.4.raw

SEQ ID NO: 558451 - DNA, 487 bp, Homo sapiens; identical to SEQ ID NO: 538190
  misc_feature: HIJSMM301BQQLA.47.70.G04.1.454.light.4.raw

SEQ ID NO: 558452 - DNA, 441 bp, Homo sapiens; identical to SEQ ID NO: 535074
  misc_feature: HIJSMM301AN6QT.11.3.A03.1.454.light.4.raw

SEQ ID NO: 558453 - DNA, 502 bp, Homo sapiens; identical to SEQ ID NO: 542039
  misc_feature: HIJSMM301C9UOC.2.76.G10.1.454.light.4.raw

SEQ ID NO: 558454 - DNA, 505 bp, Homo sapiens; identical to SEQ ID NO: 535503
  misc_feature: HIJSMM301CBUEW.8.28.C06.1.454.light.4.raw

SEQ ID NO: 558455 - DNA, 505 bp, Homo sapiens; identical to SEQ ID NO: 535503
  misc_feature: HIJSMM301C54WM.8.28.C06.1.454.light.4.raw

SEQ ID NO: 558456 - DNA, 484 bp, Homo sapiens
  misc_feature: HIJSMM301B8SOZ.22.59.F04.1.454.light.4.raw
acatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagacgccacactctcctgcagggccagtcagagtgttagcagcagcttagcctggtaccagcagaaacctggccaggctcccaggcctcctcatctatggtgcatctacgagggccacgtggtatcccagccaggttcagtggcagtgggtctgggacagagttcactctcaccatcagcagcctgcagtctgaagattttgctagtttattactgtcagcactataataactggcctccgtacagttttggccaggggaccaagctggagatcaaacgaa

SEQ ID NO: 558457 - DNA, 499 bp, Homo sapiens
  misc_feature: HIJSMM301BFX57.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccggggccactaatatcccagccaggttcagtggcagtgggtcggggtcagagttcactctcaccatcagcagcctgtagtctgaagattttgcagtttattactgtcagcagtatgatacctggcctccgtacacttttggccgggggaccaagctggaaatcaagcgaactgtggctgcaccatctgtcttcatcttcccg

SEQ ID NO: 558458 - DNA, 508 bp, Homo sapiens
  misc_feature: HIJSMM301EPA09.48.24.C02.1.454.light.4.raw
  modified_base (377)..(377): a, c, t, g, unknown or other
agtatacatacacgaccggtgctcgatttagtacagatcgttagggaaagggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaagctgctcatttactcggcatccacccggaaatccggagttcctgaccgattccgtggcagcgggtctgggacagattttacnctcaccatcagtagcctgcaggctgaagatgtggcagtttattactgtcaacaatattattatactccgccgacgttcggccggggaccgaaccgtggaaatcaaacgaactagtggctgcaccatctgtt

SEQ ID NO: 558459 - DNA, 499 bp, Homo sapiens; identical to SEQ ID NO: 543922
  misc_feature: HIJSMM301ELSJV.18.11.A11.1.454.light.4.raw

SEQ ID NO: 558460 - DNA, 537 bp, Homo sapiens
  misc_feature: HIJSMM301EM2CI.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgccccccgacctactcctaccgttccggaaccggaacgggaccaaccgtacgtaggaagttaaacgttaaaaccgtaacgttggtcggtcgtcgaccaacctacttcgttcgttccttact

SEQ ID NO: 558461 - DNA, 494 bp, Homo sapiens; identical to SEQ ID NO: 534994
  misc_feature: HIJSMM301A5832.27.78.H01.1.454.light.4.raw

SEQ ID NO: 558462 - DNA, 508 bp, Homo sapiens
  misc_feature: HIJSMM301BIPJ1.15.66.F11.1.454.light.4.raw
tctacgtagccacgaccggtgctcgatttagtcacgcgagaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaagcccccaaagtcatcatttatgagctcactaagcggccctcaggggtccctgatcgcttctctggctccaagtctggcgactcggcctccctgaccgtctctgggctccagcctgaagatgaggctgattatttctgcggctcatatggagacaattacagctttgtcttcggaagtgggaccaaggtcaccgtcctaagtcagcccaaggccaaccccactgtcactctgttcccgccctcccg

SEQ ID NO: 558463 - DNA, 492 bp, Homo sapiens
  misc_feature: HIJSMM301D9ULI.10.33.C11.1.454.light.4.raw
catagtagtgcacgaccggtgctcgatttagagtgagctcgttgggtttggggcaggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagatttgcgacatattactgtcaacagtatgaaaatgtcccgctcactttcggcgggggaccaaggtggagttcaaacgaactgtggctgcaccatctgtctt

SEQ ID NO: 558464 - DNA, 492 bp, Homo sapiens
  misc_feature: HIJSMM301D4W55.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaacgcccccaagtcgttctctatgatgtcactaagcggcctcaggagtccctgatcgattctctggctccaagtctggcaacacggcctcctgaacatctctgggctccaggctgaggatgaggctgattattattgctgctcatatggaagtacctactcttttctcttcggaactgggaccacggtcacgtcctaggtcagcccaaggcccaaccc

SEQ ID NO: 558465 - DNA, 511 bp, Homo sapiens
  misc_feature: HIJSMM301EERH3.17.2.A02.1.454.light.4.raw
cgtagactagcacgaccggtgctcgatttagactcatctacagggggggtagagaagacaggactcaggacaatctccagcatggccagcttccctctcctcctcaccctcctcactcactgtgcagggtcctgggcccagtctgtactgactcagccaccctcagcgtctgggacccccggacagagggtcaccatctcttgttctggaagcagctccaacatcgggactaatactgtaacctggttccagcacgtcccaggaacggcccccaaactcgtcatgtataattatagtcagcggccctcaggggtccctgaccgattcgctggctccaactctggcacctcagcctccctggccatcagtgggctccagtctgaggatgaggctgattattactgtgcagcatgggatgccagcctgagtagtcccgtcttcggaactgggaccaaggtcaccgtcctacgtcagcccaaggccaaccccactgtcactctgttcccgccct

SEQ ID NO: 558466 - DNA, 490 bp, Homo sapiens; identical to SEQ ID NO: 541567
  misc_feature: HIJSMM301ATSBS.22.65.F10.1.454.light.4.raw

SEQ ID NO: 558467 - DNA, 505 bp, Homo sapiens
  misc_feature: HIJSMM301AWP31.18.59.F04.1.454.light.4.raw
tacgagtatgcacgaccggtgctcgatttagtacacacacttagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaacagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaaccccca

SEQ ID NO: 558468 - DNA, 505 bp, Homo sapiens; identical to SEQ ID NO: 541723
  misc_feature: HIJSMM301CMTIG.5.24.C02.1.454.light.4.raw

SEQ ID NO: 558469 - DNA, 479 bp, Homo sapiens; identical to SEQ ID NO: 540873
  misc_feature: HIJSMM301BYGDH.40.59.F04.1.454.light.4.raw

SEQ ID NO: 558470 - DNA, 491 bp, Homo sapiens; identical to SEQ ID NO: 535294
  misc_feature: HIJSMM301A3K5M.16.68.G02.1.454.light.4.raw

SEQ ID NO: 558471 - DNA, 521 bp, Homo sapiens; identical to SEQ ID NO: 538715
  misc_feature: HIJSMM301C0C2L.27.23.C01.1.454.light.4.raw

SEQ ID NO: 558472 - DNA, 440 bp, Homo sapiens
  misc_feature: HIJSMM301EL5K5.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgccccctcggtcactctgttccaccctcctcgtatctctcg

SEQ ID NO: 558473 - DNA, 478 bp, Homo sapiens; identical to SEQ ID NO: 535129
  misc_feature: HIJSMM301BUYF6.11.11.A11.1.454.light.4.raw

SEQ ID NO: 558474 - DNA, 491 bp, Homo sapiens; identical to SEQ ID NO: 543050
  misc_feature: HIJSMM301D05QC.10.72.G06.1.454.light.4.raw

SEQ ID NO: 558475 - DNA, 484 bp, Homo sapiens; identical to SEQ ID NO: 535211
  misc_feature: HIJSMM301DU0TQ.47.46.E02.1.454.light.4.raw

SEQ ID NO: 558476 - DNA, 485 bp, Homo sapiens; identical to SEQ ID NO: 556600
  misc_feature: HIJSMM301CBK7T.46.26.C04.1.454.light.4.raw

SEQ ID NO: 558477 - DNA, 497 bp, Homo sapiens
  misc_feature: HIJSMM301D2OSK.12.87.H10.1.454.light.4.raw
atacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcattgggggaaaagtttgctttctggtatcagcagaagccaggccagtcccctgtcttggtcatctataaggatagcaggcggccctcagggattcctgagcgattctccggctccaactccggcaacacagccactctgaccatcagcgggacccaggctctcgatgaggctgactattactgccaggcgtgggacagctccacttcccgttatgtcttcggaggtggaccatggtcaccgtcctaggtcagcccaagacccaaccccactgt

SEQ ID NO: 558478 - DNA, 521 bp, Homo sapiens
  misc_feature: HIJSMM301D0345.10.28.C06.1.454.light.4.raw
catagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagcccccaaactgatgatttatgatgtcagtaatcgaccctcaggggtttctgatcgcttctttgcctccaagtctggcaacacggcctccctgaccatctctgggctccagactgaggacgaggctgattattactgcagctcacatacaagcggcagcggttgggtgttcgggcgggggaccgacactgaccgtcctaggtcacgccaaggctcgccccctcggtcactctcgttccccg

SEQ ID NO: 558479 - DNA, 486 bp, Homo sapiens; identical to SEQ ID NO: 540241
  misc_feature: HIJSMM301D4PG9.46.26.C04.1.454.light.4.raw

SEQ ID NO: 558480 - DNA, 489 bp, Homo sapiens; identical to SEQ ID NO: 541346
  misc_feature: HIJSMM301D9FV4.13.87.H10.1.454.light.4.raw

SEQ ID NO: 558481 - DNA, 508 bp, Homo sapiens
  misc_feature: HIJSMM301D2JVH.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgacgtcctaggtcagcccaaggctgccccctcggtcactctgtt

SEQ ID NO: 558482 - DNA, 494 bp, Homo sapiens; identical to SEQ ID NO: 552502
  misc_feature: HIJSMM301BHI6R.13.11.A11.1.454.light.4.raw

SEQ ID NO: 558483 - DNA, 505 bp, Homo sapiens; identical to SEQ ID NO: 535503
  misc_feature: HIJSMM301C2X7Y.8.28.C06.1.454.light.4.raw

SEQ ID NO: 558484 - DNA, 505 bp, Homo sapiens
  misc_feature: HIJSMM301CGIIT.4.10.A10.1.454.light.4.raw
agcactgtagcacgaccggtgctcgatttagcgtcgatctcaggggggtagagaagacaggactcaggacaatctccagcatggccagcttccctctcctcctcaccctcctcactcactgtgcagggtcctgggcccactctgtgctgactcagccaccctcagcgtctgggacccccgggcagagggtcaccatctcttgttctggaagcacctccaacatcggaagtaatcctgtaaactggttccagcaactcccaggaagggcccccaaagtcctcatctatggtcagaatcagcgtccctcaggggtccctgaccgattctctggctccaagtctgacacctcagcctccctggccatcagtgggctccagtctgaggatgaggctgattattactgtgcaacatgggatgacatcctacgtggtgcggtgttcggcgagggaccaagttgaccgtcctgggtcagcccaaggctgccccctcggtcactctgttcccg

SEQ ID NO: 558485 - DNA, 500 bp, Homo sapiens
  misc_feature: HIJSMM301CH1VP.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctcctgacaatctctgggctccaggctgacgacgaggctaattattactgctgctcatatgaaggttataacactatactattcggcggagggaccaagctgaccgtcctgcgtcagcccaaggctgccccctcggtcact

SEQ ID NO: 558486 - DNA, 415 bp, Homo sapiens
  misc_feature: HIJSMM301C6W3F.18.78.H01.1.454.light.4.raw
tacgagtatgcacgaccggtgctcgatttagtgtgagtagtttgggtttgggggctttgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaacccactgtcactctgttcccaccctcctccatactcgta

SEQ ID NO: 558487 - DNA, 497 bp, Homo sapiens; identical to SEQ ID NO: 535286
  misc_feature: HIJSMM301DBVUC.18.59.F04.1.454.light.4.raw

SEQ ID NO: 558488 - DNA, 502 bp, Homo sapiens
  misc_feature: HIJSMM301AP8TG.48.34.D01.1.454.light.4.raw
agtatacatacacgaccggtgctcgatttagatcgtctgtgttgggtttggggtggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaagctgaccgtcctaggtcagcccaaggctgccccccg

SEQ ID NO: 558489 - DNA, 503 bp, Homo sapiens; identical to SEQ ID NO: 536834
  misc_feature: HIJSMM301D0L35.2.35.D02.1.454.light.4.raw

SEQ ID NO: 558490 - DNA, 503 bp, Homo sapiens; identical to SEQ ID NO: 536834
  misc_feature: HIJSMM301CWM6D.2.35.D02.1.454.light.4.raw

SEQ ID NO: 558491 - DNA, 479 bp, Homo sapiens
  misc_feature: HIJSMM301A6SSU.16.86.H09.1.454.light.4.raw
tgtactactccacgaccggtgctcgatttagtgctatagacttgggtttggggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgcatctcatatacaaccaacagcactctcgactggtattcggcggagggaccaagctgaccgtcctaggtcagcccaaggctgccccctcggtcactctgttccccgccctcctcgagtagtaca

SEQ ID NO: 558492 - DNA, 509 bp, Homo sapiens
  misc_feature: HIJSMM301C6WNZ.17.28.C06.1.454.light.4.raw
cgtagactagcacgaccggtgctcgatttagagctcacgtattggggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggcccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggctgcccccc

SEQ ID NO: 558493 - DNA, 492 bp, Homo sapiens
  misc_feature: HIJSMM301DLCWF.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagaaccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatctgtcttcatcttccg

SEQ ID NO: 558494 - DNA, 472 bp, Homo sapiens; identical to SEQ ID NO: 536302
  misc_feature: HIJSMM301A4C2R.18.76.G10.1.454.light.4.raw

SEQ ID NO: 558495 - DNA, 493 bp, Homo sapiens; identical to SEQ ID NO: 543036
  misc_feature: HIJSMM301AMP4F.43.61.F06.1.454.light.4.raw

SEQ ID NO: 558496 - DNA, 484 bp, Homo sapiens; identical to SEQ ID NO: 535400
  misc_feature: HIJSMM301DND75.46.26.C04.1.454.light.4.raw

SEQ ID NO: 558497 - DNA, 523 bp, Homo sapiens
  misc_feature: HIJSMM301DBADZ.27.23.C01.1.454.light.4.raw
  modified_base (496)..(496): a, c, t, g, unknown or other
agcgtcgtctcacgaccggtgctcgatttagtacacgtgattagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtggttcggcggagggaccaggctgaccgtcctaggtcagcccaaggctnccccctcggtcactctgttcccaccct

SEQ ID NO: 558498 - DNA, 444 bp, Homo sapiens; identical to SEQ ID NO: 535411
  misc_feature: HIJSMM301CQMBR.8.73.G07.1.454.light.4.raw

SEQ ID NO: 558499 - DNA, 494 bp, Homo sapiens; identical to SEQ ID NO: 540110
  misc_feature: HIJSMM301A57W2.51.71.G05.1.454.light.4.raw

SEQ ID NO: 558500 - DNA, 486 bp, Homo sapiens; identical to SEQ ID NO: 535043
  misc_feature: HIJSMM301DSYHH.46.35.D02.1.454.light.4.raw

SEQ ID NO: 558501 - DNA, 485 bp, Homo sapiens
  misc_feature: HIJSMM301DX6TO.7.75.G09.1.454.light.4.raw
  modified_base (470)..(470): a, c, t, g, unknown or other
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacaggctgcccccaaccttcggccaggggacacgactggagattaaacgaactgnggctgcacatctgtt

SEQ ID NO: 558502 - DNA, 498 bp, Homo sapiens
  misc_feature: HIJSMM301BZ57F.8.10.A10.1.454.light.4.raw
ctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaaagagccaccctctcctgcagggccagtcttagtgttagcaacttagcctggtaccaacagaaacctggccaggctcccaggctcctcatctctgatacatccaacagggccactggcatcccagccaggttcagtggcagtgggtctgggacagacttcactctcaccatcagcagcctagagcctgaagattttgcactttattactgtcagcagcgtagtaactggcctttcactttcggccctgggaccaaagtggatatcaaacgaactgtggctgcaccaatctgtcttcatcttcccgccat

SEQ ID NO: 558503 - DNA, 494 bp, Homo sapiens; identical to SEQ ID NO: 534992
  misc_feature: HIJSMM301C2BBA.9.1.A01.1.454.light.4.raw

SEQ ID NO: 558504 - DNA, 505 bp, Homo sapiens; identical to SEQ ID NO: 535987
  misc_feature: HIJSMM301BW9MG.18.37.D04.1.454.light.4.raw

SEQ ID NO: 558505 - DNA, 507 bp, Homo sapiens; identical to SEQ ID NO: 535316
  misc_feature: HIJSMM301B6H7J.18.37.D04.1.454.light.4.raw

SEQ ID NO: 558506 - DNA, 498 bp, Homo sapiens
  misc_feature: HIJSMM301C2LIY.11.21.B10.1.454.light.4.raw
cgagagataccacgaccggtgctcgatttagtgtcgtcgcaaggagagggggaggaactgctcagttaggacccagagggaaccatggaagccccagctcagcttctcttcctcctgctactctggctcccagatagcaccggagaaattgtgttgacacagtctccagccaccctgtctttgtctccaggggaaagagccaccctctcctgcagggccagtcagagtgttaacagctacttagcctggtaccaacagaaacctggccagactcccaggctcctcatctatgatgcatccaacagggccactggcaccccagccaggttcagtggcagtgggtctgggacagacttcactctcaccatcagcagcctagagcctgaggattttgcagtttattactgtcagcagcgtatcgactggatcaccttcggccaagggacacgactggaaattaaacgaactgtggctgcacatctgtcttcatcttccccg

SEQ ID NO: 558507 - DNA, 443 bp, Homo sapiens
  misc_feature: HIJSMM301DWKRF.48.59.F04.1.454.light.4.raw
agtatacatacacgaccggtgctcgatttagtacacacacttagggattgggggcccagtctgtgctgactcagccaccctcagcgtctgggacccccggtcagagtgtcaccatctcttgttctggaagcggctccaacatcggaagaaatactgtgaactggtaccagcagctcccaggagcggcccccagactctacatctataataattatcgccggccctcaggggtccctgaccgagtctctgcctccaagtctggcacctcagcctccctggccatcagtggcctccggtctgaagaggagggtgattattactgtgcagcgtgggatgacagcctgaatgcttgggtgttcggcggagggaccaagttgaccgtcctaggtcaacccaaggctgccccctcggtcactctgttcccaccctcctctatgtatact

SEQ ID NO: 558508 - DNA, 496 bp, Homo sapiens
  misc_feature: HIJSMM301AWYP8.5.12.B01.1.454.light.4.raw
atcagacacgcacgaccggtgctcgatttagtagtgtagattccgcggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaacagtgacattggtgcttatgactatgtctcgtggtatcaaaagtatccagacacagcccccaaactcatcctttatgatgtccgtgttcggccctcaggggtttctgttcgcttctctggctccaagtctggcagcacggcctccctgaccatctctgggctccaggctgaggacgaggctgactattattgcagttcatatggtagtatgaagactcttgtgattttcggcggagggaccaagctgaccgtcctgagtcagcccaaggctcg

SEQ ID NO: 558509 - DNA, 487 bp, Homo sapiens
  misc_feature: HIJSMM301ECFHU.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggctagtttattattgtcaacaatattattatacttcgtggacgttcggccgaaggaccaaggtggatatcagacgaa

SEQ ID NO: 558510 - DNA, 516 bp, Homo sapiens; identical to SEQ ID NO: 547638
  misc_feature: HIJSMM301ENFE3.47.53.E09.1.454.light.4.raw

SEQ ID NO: 558511 - DNA, 497 bp, Homo sapiens; identical to SEQ ID NO: 535664
  misc_feature: HIJSMM301ELQPT.22.14.B03.1.454.light.4.raw

SEQ ID NO: 558512 - DNA, 454 bp, Homo sapiens; identical to SEQ ID NO: 534964
  misc_feature: HIJSMM301AQW9R.19.86.H09.1.454.light.4.raw

SEQ ID NO: 558513 - DNA, 494 bp, Homo sapiens; identical to SEQ ID NO: 543247
  misc_feature: HIJSMM301DF6IM.22.57.F02.1.454.light.4.raw

SEQ ID NO: 558514 - DNA, 445 bp, Homo sapiens
  misc_feature: HIJSMM301DNODG.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgtttggcggcgggaccaagttgaccgtcctacgtcagcccaaggctgccccctcggtcactctgttccccaccctcctcgacacgcgag

SEQ ID NO: 558515 - DNA, 511 bp, Homo sapiens; identical to SEQ ID NO: 537047
  misc_feature: HIJSMM301AX66C.5.27.C05.1.454.light.4.raw

SEQ ID NO: 558516 - DNA, 447 bp, Homo sapiens; identical to SEQ ID NO: 535020
  misc_feature: HIJSMM301CIIW0.18.9.A09.1.454.light.4.raw

SEQ ID NO: 558517 - DNA, 485 bp, Homo sapiens; identical to SEQ ID NO: 543180
  misc_feature: HIJSMM301CTFCY.3.10.A10.1.454.light.4.raw

SEQ ID NO: 558518 - DNA, 521 bp, Homo sapiens; identical to SEQ ID NO: 538715
  misc_feature: HIJSMM301D8IRU.27.23.C01.1.454.light.4.raw

SEQ ID NO: 558519 - DNA, 504 bp, Homo sapiens
  misc_feature: HIJSMM301A4TBM.18.26.C04.1.454.light.4.raw
tacgagtatgcacgaccggtgctcgatttagtctagcgactttggggtttgggggggtcagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaaagcccctaacctcctgatcaagggtccgtccagtttccagagtggggcctcaacaaggttcagcggcagtggatctgggacagatttcactctcaccatcaccagcctgcagcctgaagattttgcaacttactattgtcaacaggctgacaggttcccgctgactttcggcggagggaccaaggtagagatcaaaggaactgtggctgcaccatctgtcttcactcttcccgccca

SEQ ID NO: 558520 - DNA, 493 bp, Homo sapiens
  misc_feature: HIJSMM301BBXV8.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggccagcagtggtaacattgtgatattcggcggagggaccaaggtgaccgtcctatgtcagcccaaggctgccccctcggtcact

SEQ ID NO: 558521 - DNA, 490 bp, Homo sapiens
  misc_feature: HIJSMM301BD5J2.16.72.G06.1.454.light.4.raw
tgtactactccacgaccggtgctcgatttagctacgactgcaagggaaagggggaggaactgctcagttaggacccagacggaaccatggaagccccagcgcagcttctcttcctcctgctactctggctcccagatacctctggagaaacagtgatgacgcagtctccagccaccctctctgtgtctccaggggaaagagtcaccctctcctgcagggccagtcagagtgttagcagcaacttagcctggtatcagcagaaacctggccaggctcccaggctcctcatctatgatgcatccaccagggccactggtatcccagccaggttcagtggcagtgggtttgggacagagttcactctcaccatcagcagcctgcagtctgaagattttgctagtttattactgtcagcagtataataactggcctccggtcactttcggcggagggaccaaggtggagatcaaacgaactgtggctgcaccat

SEQ ID NO: 558522 - DNA, 488 bp, Homo sapiens; identical to SEQ ID NO: 542699
  misc_feature: HIJSMM301CMSWA.12.51.E07.1.454.light.4.raw

SEQ ID NO: 558523 - DNA, 517 bp, Homo sapiens
  misc_feature: HIJSMM301EF3SF.12.71.G05.1.454.light.4.raw
atacgacgtacacgaccggtgctcgatttagtgtcgtcgcaagagagagggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgaggacactaagcggccctcaggagtttctgatcgcttctctggctccaaggctggtgaccgggcctccctgacaatatctgggctccaggctgaggacgaggctcattactactgctgctcatatggaggttatagcacttgggtgttcggcggcgggaccaaagtgaccgtcctaagtcagcccaaggctgccccctcggtcactctgttcccaccct

SEQ ID NO: 558524 - DNA, 462 bp, Homo sapiens
  misc_feature: HIJSMM301BUQB6.49.73.G07.1.454.light.4.raw
agtcgagagacacgaccggtgctcgatttagctctacgctcagggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcgtgtatctgaattggtatcagcaaaaaccagggaaagcccctgagctcctgatcctcgatgcatccaatttggaaacaggggtcccatcgaggttctctggaagtggctctgggacacatttttactttcaccatcagcagactgcagcctgaagatattgcaacatattactgtcaacagtatgataatctcccgctcactttcggcgagggaccaaggtggagatcaaacgaa

SEQ ID NO: 558525 - DNA, 447 bp, Homo sapiens; identical to SEQ ID NO: 535020
  misc_feature: HIJSMM301BSX2I.18.9.A09.1.454.light.4.raw

SEQ ID NO: 558526 - DNA, 515 bp, Homo sapiens
  misc_feature: HIJSMM301DLGL6.16.85.H08.1.454.light.4.raw
tgtactactccacgaccggtgctcgatttagtatcactcagtcgcggggctgggcctaaggaagcagcactggtggtgcctcagccatggcctggaccgttctcctcctcggcctcctctctcactgcacaggctctgtgacctcctatgtgctgactcagccaccctcggtgtcgttggccccaggacagacggccttaataacctgtgggggaagcaacattggaagcaaaaatgtgcactggtacatgcagaggccaggccaggcccctgttttggtcgtctatgatgataccgagcggccctcagggatccctgagcgattctccggctccaactctggtgacacggccaccctgaccatcaacagggtcgaagtcggggatgaggccgactattactgtcaggtgtgggatggtgttagtgatcgggcacttttcggcggagggacccagctgaccgtcctaggtcagcccaaggctgccccctcggtcactctgttcccgccctcctcg

SEQ ID NO: 558527 - DNA, 508 bp, Homo sapiens; identical to SEQ ID NO: 540565
  misc_feature: HIJSMM301AMYKI.51.86.H09.1.454.light.4.raw

SEQ ID NO: 558528 - DNA, 487 bp, Homo sapiens; identical to SEQ ID NO: 547658
  misc_feature: HIJSMM301C9HMC.4.27.C05.1.454.light.4.raw

SEQ ID NO: 558529 - DNA, 504 bp, Homo sapiens
  misc_feature: HIJSMM301A8TF7.41.35.D02.1.454.light.4.raw
tctatactatcacgaccggtgctcgatttagcacacgatagttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggtaccatcagcgatgttgattattataaccttgtctcctggtaccaacaacacccaggcaaagcccccaaactcctgatttatgagggcgatcagcggccctcaggggtttctgatcgcttctctggctccaagtctggcaatacggcctccctgacagtctctcggctccaggcggaggacgaggctgattactactgcttctcatatgcagatactaagtcctgggtgttcggcggagggaccaagctgaccgtcctaggtcagcccaaggctgccccctcggt

SEQ ID NO: 558530 - DNA, 486 bp, Homo sapiens
  misc_feature: HIJSMM301B8W6F.43.36.D03.1.454.light.4.raw
tgtgagtagtcacgaccggtgctcgatttagctgcgtcacgatctctcttgggggagctacaacaggcaggcaggggcagcaagatggtgttgcagacccaggtcttcatttctctgttgctctggatctctggtgccttcggggacatcgtgatgacccagtctccaggttccctggctgtctctctgggcgagagggccacgctcaagtgcacctccagcgagagtgtgttgtatccccccaccatcagcacgccttagcctggtaccagcacaagtcagggcagcctcctaagttgctcttttactggacttcgatccgcgcatctggggtccctgaccgattcatgggcagcggctctgggacagacttcgctctcaccatcaacagcctccaggctgaggatgcggcggtttattattgtcaacaatattttagtgctccgtacacttttggccaggggaccaagttggagatcaaacgaa

SEQ ID NO: 558531 - DNA, 489 bp, Homo sapiens
  misc_feature: HIJSMM301CLFOJ.19.57.F02.1.454.light.4.raw
tactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgcaactttatttttgtcaacaggctaacactttccccctcacctttcggcggaggaccaaggtggagatcaagcgaactgtggctgcaccat

SEQ ID NO: 558532 - DNA, 503 bp, Homo sapiens; identical to SEQ ID NO: 538973
  misc_feature: HIJSMM301DXACL.5.86.H09.1.454.light.4.raw

SEQ ID NO: 558533 - DNA, 512 bp, Homo sapiens
  misc_feature: HIJSMM301BMVU9.5.60.F05.1.454.light.4.raw
atcagacacgcacgaccggtgctcgatttagtacgtcatcagggaaaggggcagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcaggagggtcaccatctcttgttctggaagcacctccaacatcggaagtaatattgtaaactggtaccagcagctcccaggaaccggcccccaaactcctcatctataggaataatcaacggccctcaggggtccctgaccgattctctggctccaagtctggcacctcagcctccctggccatccgtgggctccagtctgaggatgagtctgattattactgtgcaacatgggatgacagcctgaatggtccggtattcggcggagggaccaagctgaccgtcctcggtcagcccaaggctcgccccccg

SEQ ID NO: 558534 - DNA, 480 bp, Homo sapiens
  misc_feature: HIJSMM301B9R95.48.28.C06.1.454.light.4.raw
agtatacatacacgaccggtgctcgatttagagctcacgtattgggtttgggggctgtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagccc

SEQ ID NO: 558535 - DNA, 503 bp, Homo sapiens; identical to SEQ ID NO: 550542
  misc_feature: HIJSMM301DT4D4.2.76.G10.1.454.light.4.raw

SEQ ID NO: 558536 - DNA, 503 bp, Homo sapiens
  misc_feature: HIJSMM301A6J7L.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtagctcccgggacaacagtggtaaccatgtggtattcggcggagggaccaaactgaccgtcctaggtcagcccaaggctgccccctcggtcactctgttccccg

SEQ ID NO: 558537 - DNA, 488 bp, Homo sapiens
  misc_feature: HIJSMM301B4UGF.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccattttgcatagtggggtcccatctaggttcagtggcagtggatctgggacagatttcactctcaccatcagcagtctgcaacctgaagattttgcaacttactactgtcaacagagttacggtaccccgtacacttttggccaggggaccaaactggacatcaaacgaactgtggctgcaccatctgtt

SEQ ID NO: 558538 - DNA, 488 bp, Homo sapiens; identical to SEQ ID NO: 536861
  misc_feature: HIJSMM301BQCAC.12.88.H11.1.454.light.4.raw

SEQ ID NO: 558539 - DNA, 489 bp, Homo sapiens
  misc_feature: HIJSMM301DDSOY.51.6.A06.1.454.light.4.raw
cgatcgtatacacgaccggtgctcgatttagatctactgacaggggctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgattctctggctccacctcagggacaatggtcacattgaccatcagtggagtccaggcagaagacgaggctgactatttctgtcaatcttcagacatcagtggtacttatgtcttcggaactgggaccaaggtcaccgtcctaggtcagcccaaggccaacccactgtcta

SEQ ID NO: 558540 - DNA, 486 bp, Homo sapiens; identical to SEQ ID NO: 535458
  misc_feature: HIJSMM301CWCTL.7.75.G09.1.454.light.4.raw

SEQ ID NO: 558541 - DNA, 496 bp, Homo sapiens; identical to SEQ ID NO: 548177
  misc_feature: HIJSMM301AV7T2.18.59.F04.1.454.light.4.raw

SEQ ID NO: 558542 - DNA, 493 bp, Homo sapiens; identical to SEQ ID NO: 535770
  misc_feature: HIJSMM301ELFEI.51.71.G05.1.454.light.4.raw

SEQ ID NO: 558543 - DNA, 518 bp, Homo sapiens; identical to SEQ ID NO: 540171
  misc_feature: HIJSMM301BJYK3.49.10.A10.1.454.light.4.raw

SEQ ID NO: 558544 - DNA, 513 bp, Homo sapiens; identical to SEQ ID NO: 536917
  misc_feature: HIJSMM301AL3L4.16.83.H06.1.454.light.4.raw

SEQ ID NO: 558545 - DNA, 494 bp, Homo sapiens
  misc_feature: HIJSMM301CJN33.40.83.H06.1.454.light.4.raw
tctagcgactcacgaccggtgctcgatttagatcacgtgcgtcgcggggcaaaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttctagcatgggacggcagcctccagtgaatgggtgttcggtcggaggggaccaaactagtccgtcctacggtcagaccccg

SEQ ID NO: 558546 - DNA, 504 bp, Homo sapiens; identical to SEQ ID NO: 537401
  misc_feature: HIJSMM301DJNED.51.23.C01.1.454.light.4.raw

SEQ ID NO: 558547 - DNA, 513 bp, Homo sapiens
  misc_feature: HIJSMM301EP3HK.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtctaggtcagcccaaggctgccccctcggtcactctgttccccg

SEQ ID NO: 558548 - DNA, 487 bp, Homo sapiens; identical to SEQ ID NO: 536206
  misc_feature: HIJSMM301DOQHI.47.38.D05.1.454.light.4.raw

SEQ ID NO: 558549 - DNA, 492 bp, Homo sapiens; identical to SEQ ID NO: 534967
  misc_feature: HIJSMM301ETIQZ.47.64.F09.1.454.light.4.raw

SEQ ID NO: 558550 - DNA, 466 bp, Homo sapiens
  misc_feature: HIJSMM301BZFFF.12.39.D06.1.454.light.4.raw
atacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatgagggaggggaatggggtgagaaagatccagtgtagagattgtgatgacccagactccagtctccttgtctctcacccctggagagcaggcctccatgtcctgcaggtctagtctgcgcctcctgcatagtgacggatgctcccttttgtattggtttctgcagagaggcaggccagtctccacaactcctgatctatgaagttgccacccggctctctggagtgccagatatgttcagtggctgcgggtcaggcacagatctcacactagaaaaacagccgggtggagagtgaccatgttggaacttatta

SEQ ID NO: 558551 - DNA, 518 bp, Homo sapiens
  misc_feature: HIJSMM301EF39Q.48.61.F06.1.454.light.4.raw
agtatacatacacgaccggtgctcgatttagctacgctctaagggaaaggggtggtctgggcctaaggaagcagcactggtggtgcctcagccatggcctggaccgttctcctcctcggcctcctctctcactgcacagggtcggtgacttcctatgtgctgactcagcccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatccggtcttcggcggagggaccaagttgaccgtcctaagtcagcccaaggctgccccctcggtcactctgttcccgccct

SEQ ID NO: 558552 - DNA, 513 bp, Homo sapiens
  misc_feature: HIJSMM301DX4ZF.13.53.E09.1.454.light.4.raw
tcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcggcctaacgggaccgaacggtacggaaagtacaagacggaactagtggcgtgcaccactctgtcttctact

SEQ ID NO: 558553 - DNA, 479 bp, Homo sapiens; identical to SEQ ID NO: 538892
  misc_feature: HIJSMM301BUJF0.22.59.F04.1.454.light.4.raw

SEQ ID NO: 558554 - DNA, 496 bp, Homo sapiens; identical to SEQ ID NO: 553382
  misc_feature: HIJSMM301DZP94.51.59.F04.1.454.light.4.raw

SEQ ID NO: 558555 - DNA, 485 bp, Homo sapiens; identical to SEQ ID NO: 535606
  misc_feature: HIJSMM301AH84A.47.46.E02.1.454.light.4.raw

SEQ ID NO: 558556 - DNA, 494 bp, Homo sapiens; identical to SEQ ID NO: 539922
  misc_feature: HIJSMM301DJY8D.27.78.H01.1.454.light.4.raw

SEQ ID NO: 558557 - DNA, 506 bp, Homo sapiens; identical to SEQ ID NO: 536355
  misc_feature: HIJSMM301CDYE4.47.85.H08.1.454.light.4.raw

SEQ ID NO: 558558 - DNA, 498 bp, Homo sapiens
  misc_feature: HIJSMM301AK9KK.9.71.G05.1.454.light.4.raw
tgatacgtctcacgaccggtgctcgatttagtgtcgtcgcaagagagaggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcagatattcggcggagggaccaggctgaccgtcctgagtcagcccaaggctgccccc

SEQ ID NO: 558559 - DNA, 489 bp, Homo sapiens
  misc_feature: HIJSMM301ARUYH.48.42.D09.1.454.light.4.raw
agtatacatacacgaccggtgctcgatttagacacatacgcagggaaagggggaagagctgctcagttaggacccagagggaaccatggaaaccccagcgcagcttctcttcctcctgctactctggctcccagatagcaccggagaaatcgtgttgacgcagtctccaggcaccctgtctgtgtctccaggggaaagagccaccctctcctgcagggccagtcagagtgttagcagcagctacttagcctggtaccagcagaaaccgggccaggctcccaggctcctcatctatggtgcatccagcagggccactggcatcccagacaggttcagttgcagtgggtctgggacagacttcactctcaccatcagcagactggagcctgaagattttgcaatttattactgtcagcagtatggtacctcacccaggtacacttttggccaggggaccaagctggagatcaaacgaactgtggctgcacc

SEQ ID NO: 558560 - DNA, 510 bp, Homo sapiens
  misc_feature: HIJSMM301BORXF.5.58.F03.1.454.light.4.raw
atcagacacgcacgaccggtgctcgatttagtctgatcgagaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaatagcggccctcaggggtttctaatcgcttctctggctccaagtctggcaacacggccgccctgacaatctctgggctccaggctgacgacgaggctgattttactgctgctcatatgcaggtgatcacacttttatgttcgggactgggaccaaggtcaccgtcctaggtcagcccaaggccaaccccactgtcactcttcg

SEQ ID NO: 558561 - DNA, 500 bp, Homo sapiens
  misc_feature: HIJSMM301CBSCM.14.23.C01.1.454.light.4.raw
cgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagaagcaacttagcctggtaccagcagaaacctggccaggctcccaggctcctcatctatggtgcatccaccagggccactggtgtcccagccaggttcagtggcagtggggtctgggacagagttcactctcaccatcagcagcctgcagtctgaagattttgcagtttattattgtcagcagtataataactggcctccgtggacgttcggccaagggaccaaggtggaaatcaaacgaactgtggctgcaccatctgtcttcta

SEQ ID NO: 558562 - DNA, 487 bp, Homo sapiens; identical to SEQ ID NO: 535583
  misc_feature: HIJSMM301CJBVK.22.73.G07.1.454.light.4.raw

SEQ ID NO: 558563 - DNA, 377 bp, Homo sapiens
  misc_feature: HIJSMM301EMFQE.14.85.H08.1.454.light.4.raw
cgtctagtaccacgaccggtgctcgatttagtatcactcagtcaccatatcctgcactggaaccagcagtgacgttggtgcttataactttgtctcctggtaccaacagcacccaggcaaagcccccaaactcatgatttatgacgtcaataagcggccctcgggggtccctgatcgcttctctggctccaagtctggcaacacggcctccctgaccgtctctgggctccaggctgacgatgaggctgattattactgcagctcacatgcagtcagtaacaatttcgggtttcggcggagggaccaagctgaccgtcctaagtcagcccaaggctgccccctcggtcactctgttcccaccctcctcgtactagacg

SEQ ID NO: 558564 - DNA, 494 bp, Homo sapiens; identical to SEQ ID NO: 534992
  misc_feature: HIJSMM301C03R2.9.1.A01.1.454.light.4.raw

SEQ ID NO: 558565 - DNA, 483 bp, Homo sapiens
  misc_feature: HIJSMM301DNQE8.48.78.H01.1.454.light.4.raw
agtatacatacacgaccggtgctcgatttagtgtgagtagtttgggtttggggggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagcccaaggctccg

SEQ ID NO: 558566 - DNA, 483 bp, Homo sapiens; identical to SEQ ID NO: 535317
  misc_feature: HIJSMM301B92GY.4.1.A01.1.454.light.4.raw

SEQ ID NO: 558567 - DNA, 488 bp, Homo sapiens; identical to SEQ ID NO: 535990
  misc_feature: HIJSMM301DD3QQ.11.28.C06.1.454.light.4.raw

SEQ ID NO: 558568 - DNA, 505 bp, Homo sapiens; identical to SEQ ID NO: 535503
  misc_feature: HIJSMM301CSI76.8.28.C06.1.454.light.4.raw

SEQ ID NO: 558569 - DNA, 498 bp, Homo sapiens
  misc_feature: HIJSMM301EUX63.51.39.D06.1.454.light.4.raw
cgatcgtatacacgaccggtgctcgatttagtgacatctcgcagttctttgggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccaacagaagccaggccaggcccctgtgttgttgatatataaagacagtgagaggccttcagggatccctgagcgattctctggctccacctcagggacactggtcacattgaccatcagtggagtccaggcagaagacgaggctgactatttctgtcaatcttcagacgtcagtggtacttatgtcttcggaactgggaccaaggtcaccgtcctaggtcagcccaaggccaaccccactgtcactc

SEQ ID NO: 558570 - DNA, 514 bp, Homo sapiens
  misc_feature: HIJSMM301AEY09.13.4.A04.1.454.light.4.raw
tcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtaatgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggccaacccactgtcactctgttccccg

SEQ ID NO: 558571 - DNA, 490 bp, Homo sapiens; identical to SEQ ID NO: 535526
  misc_feature: HIJSMM301B5MST.26.78.H01.1.454.light.4.raw

SEQ ID NO: 558572 - DNA, 500 bp, Homo sapiens
  misc_feature: HIJSMM301AZBQY.12.48.E04.1.454.light.4.raw
atacgacgtacacgaccggtgctcgatttagagagcgtcacagagagaaggggagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatttcttgttctggaacccactccaacatcggatataattctgtagactggtaccagcagcttccaggagccggccccccgactcctcatctttaataacaatcagcggccctcaggggtccctgaccgattctctggctccaagtctggcacctcagcctccctggccatcagtgggctccagtctgaggatgaggctgattattactgtgcatcatgggctgacaccctgactggtccggagtgttcggcggagggaccaagctgaccgtctaggtcagcccaa

SEQ ID NO: 558573 - DNA, 503 bp, Homo sapiens
  misc_feature: HIJSMM301BO40C.12.50.E06.1.454.light.4.raw
atacgacgtacacgaccggtgctcgatttagatctactgacaacacacaaggggggagaagagctgctcagttaggacccagagggaaccatggaaaccccagcgcagcttctcttcctcctgctactctggctcccagataccaccggagaaattgtgttgacgcagtctccaggcaccctgtctttgtctccgggggaaagagtcaccctctcctgcagggccagtcagagtgttagcggcaactacttagcctggtaccaacagaaacctggccaggcctcccaggctcgtcatctatggtgcatccagcagggccactggcatcccagacaggttcagtggcagtgggtctgggacagacttcactctcaccatcagtagactggagcctgaagattttgcagtttattactgtcagcagtatgggggctcacgtcgattcactttcggccctgggaccaaagtagatgtcaacgaactgtggctgcaccatctgtctt

SEQ ID NO: 558574 - DNA, 488 bp, Homo sapiens
  misc_feature: HIJSMM301BU0A2.4.57.F02.1.454.light.4.raw
agcactgtagcacgaccggtgctcgatttagctcgatatagttgggtttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtggggtcccatcaagattcagtggcagtggatctgggacagatttcactctcaccatcagtagtctacaacctgaagattttgctaacttactactgtcaacagagttacgactacccctccgctcactttcggcggagggaccaaggtggagatacaaacgaactgtggctgcacc

SEQ ID NO: 558575 - DNA, 485 bp, Homo sapiens
  misc_feature: HIJSMM301ETAGE.47.78.H01.1.454.light.4.raw
agctcacgtacacgaccggtgctcgatttagtgtgagtagtttgggtttgggaacctatgaacattctgtaggggccactgtcttctccacggtgctcccttcatgcgtgactcagccaccctcagcgtctgggacccccggcagagggtcgtcatctcttgctctggaagcagctccaacatcggaaggaatgatgtgtactggttgcagcaactccccggaacggccccaaactcctcatctatacgaataatcagcggtcctcaggggtccctgaccgattctctggctccaagtctgacacctcagcctccctggccatcagtgggctccggtccgaggatgaggctgattattattgtgcaacattggggatagtagcctgagtagtgtggttttcggcggagggaccaaactgaccgtcctaggtcagcccaaggctgccccctcggtcactctgttcccaccctcctctacgtgagct

SEQ ID NO: 558576 - DNA, 495 bp, Homo sapiens; identical to SEQ ID NO: 543296
  misc_feature: HIJSMM301D5TFZ.11.10.A10.1.454.light.4.raw

SEQ ID NO: 558577 - DNA, 473 bp, Homo sapiens
  misc_feature: HIJSMM301BQGW0.52.56.F01.1.454.light.4.raw
cgcagtacgacacgaccggtgctcgatttagcagacgtctgaacacacaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacgaagtcaccatgacttgccgggcaagtcagagcattagcagccatttgaattggtatcagcagaaacctgggaaagcccctcagctcctgatctttgctgcatccagtttgcacagtggggtcccatcaaggttcagtggcagtggatctgggacagacttcactctcaccatcagcagtctgcaacctgaggattttgccacttactactgtcaacagacttacaatacccctccatacacttttggccaggggaccaagctggagatcagaacg

SEQ ID NO: 558578 - DNA, 491 bp, Homo sapiens; identical to SEQ ID NO: 544505
  misc_feature: HIJSMM301BVWYY.16.73.G07.1.454.light.4.raw

SEQ ID NO: 558579 - DNA, 478 bp, Homo sapiens; identical to SEQ ID NO: 535129
  misc_feature: HIJSMM301BRLQP.11.11.A11.1.454.light.4.raw

SEQ ID NO: 558580 - DNA, 501 bp, Homo sapiens
  misc_feature: HIJSMM301B96YN.15.56.F01.1.454.light.4.raw
tctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaagcccccaaactcatgatttatgaggacaatgagcggccctcaggggtttctaatcgcttctctggctccaagtctgacaacacggcctccctgacaatctctgggctccaggctgaggacgagggtgattattactgctgcgcatatagaagtcccactgttgtacttttggcggagggaccaagctgaccgtcctaggtcagcccaaggctgccccctcggtcactctgttcccaccctcctcgctacgtacga

SEQ ID NO: 558581 - DNA, 490 bp, Homo sapiens
  misc_feature: HIJSMM301CW7ZK.21.65.F10.1.454.light.4.raw
tcgtcgctcgcacgaccggtgctcgatttagctacgctctaagggggaggaactgctcagttaggacccagacggaaccataggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaaacctggccagcctcccaggctcctcatctatggtgcatccgccagggccactggaatcccagccaggttcagtggcactgggtctgggacagagttcactctcaccatcagcagcctgcagtctgaagattttgaagtttatttctgtctgcagtacaatcagtggcctcggacgttcggccaagggaccaaggtggaaatcaaacgaactgtggctgcaccatctgtcttcta

SEQ ID NO: 558582 - DNA, 507 bp, Homo sapiens
  misc_feature: HIJSMM301DG471.51.16.B05.1.454.light.4.raw
cgatcgtatacacgaccggtgctcgatttagagctcacgtagttgggtttgggggatcaggactcctcagttcaccttctcacaatgaggctccctgctcagctcctgggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggtttcagcagaggccaggccaatctccaagacgcctaatttataaggtttctaaccgggactctggggtcccagacagattcagcggcagtgggtcaggcactgatttcacactgataatcgacagggtgaggctgaggatgttgggttttattactgcatgcaaggtacacactggcctgggacgttcggccaagggaccaaggtggaaatcaacgaactgtggctgcaccatctgtcttcatt

SEQ ID NO: 558583 - DNA, 494 bp, Homo sapiens
  misc_feature: HIJSMM301CBXHV.18.59.F04.1.454.light.4.raw
  modified_base (483)..(483): a, c, t, g, unknown or other
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcagcagcactctctatgtctcggaactggaccaaggtcacgtcctagtcancccaaggccaa

SEQ ID NO: 558584 - DNA, 504 bp, Homo sapiens; identical to SEQ ID NO: 549053
  misc_feature: HIJSMM301A2U30.4.71.G05.1.454.light.4.raw

SEQ ID NO: 558585 - DNA, 472 bp, Homo sapiens
  misc_feature: HIJSMM301AD1UT.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctcctccgagtgccacttttggcggggggaccgaaggtggacatcaacgaa

SEQ ID NO: 558586 - DNA, 507 bp, Homo sapiens
  misc_feature: HIJSMM301CKA9N.8.42.D09.1.454.light.4.raw
ctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgattttgaggtcaataagcggccctcaggggtccctgatcgcttctcaggctccaagtctggcaacacggcctcctgaccgtctctgggctccagactgaggatgaggctgattattactgcagctcatattcaggcagcaacagggtattcggcggagggaccaagttgaccgtcctaggtcagcccaaggctgccccctcggtcactctgttcccgcctccc

SEQ ID NO: 558587 - DNA, 493 bp, Homo sapiens
  misc_feature: HIJSMM301BAZ51.27.78.H01.1.454.light.4.raw
agcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaactgtgctgcaccatctgtt

SEQ ID NO: 558588 - DNA, 485 bp, Homo sapiens
  misc_feature: HIJSMM301A11V0.49.86.H09.1.454.light.4.raw
agtcgagagacacgaccggtgctcgatttagtgctatagacttgggtttgggggctgtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgaccaaagcaatatgcttactggtaccagcagaagccaggccaggcccctgtcttgatcatttataaagactttgagagggcctcagggacccctgagcgattctctggctccagctcagcgacaacagtcacgttgaccatcagtggagtccgggcagaggacgaggctgactattactgtcagtcatcagacagtagtggcacttctgtcgtattcggcggagggaccaagctgaccgtcctaggtcagcccaac

SEQ ID NO: 558589 - DNA, 484 bp, Homo sapiens; identical to SEQ ID NO: 535240
  misc_feature: HIJSMM301DUNGW.47.60.F05.1.454.light.4.raw

SEQ ID NO: 558590 - DNA, 506 bp, Homo sapiens
  misc_feature: HIJSMM301AEJFE.48.15.B04.1.454.light.4.raw
agtatacatacacgaccggtgctcgatttagacagtatatatccgcgggggctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaaactactcatttactcggcatccacccggaagtccgaggttcctgaccgattccgtggcagcgggtctgggacagattttactctcaccatcactaccctgcaggctgaagatgtggcagtttatactgtcaacaatattattctactccgccgacgttcggccgggggaccaacgtggaaatcaaacgaactgtggctgcaccatctgtcttcatt

SEQ ID NO: 558591 - DNA, 447 bp, Homo sapiens; identical to SEQ ID NO: 535201
  misc_feature: HIJSMM301C69PG.18.9.A09.1.454.light.4.raw

SEQ ID NO: 558592 - DNA, 494 bp, Homo sapiens; identical to SEQ ID NO: 535276
  misc_feature: HIJSMM301ENJV6.16.6.A06.1.454.light.4.raw

SEQ ID NO: 558593 - DNA, 496 bp, Homo sapiens
  misc_feature: HIJSMM301DIP71.8.64.F09.1.454.light.4.raw
ctcgcgtgtccacgaccggtgctcgatttagcgcgtatacaaggggcagcactcaggacaatctccagcatggcctggtctcctctcctcctcactctcctcgctcactgcacagggtcctgggcccagtctgagctgacgcagccgccctcagtgtctggggccccagggcagagggtcaccatctcctgcactggggacaactccaacatcggggcaggttataatgtttactggtatcaacaacttccagggacagcccccaaactcctcttgtatggtgacaactatcggccctcaggtgtccctgaccggatctctggctccaagtctggcacctcagcctccctggccatcactgggctccaggctgaagatgaggctgattattactgccagtcttatgacagccgcctgagtggctatgtgcttttcggcgggggaccaagctgaccgtcctacgtcagcccaaggctgccccctcggtcactctgtt

SEQ ID NO: 558594 - DNA, 465 bp, Homo sapiens; identical to SEQ ID NO: 540896
  misc_feature: HIJSMM301DY9FL.11.70.G04.1.454.light.4.raw

SEQ ID NO: 558595 - DNA, 518 bp, Homo sapiens
  misc_feature: HIJSMM301BGRK5.5.27.C05.1.454.light.4.raw
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagccaaggccaacccactgtcactctgttcccaccctcctccgtcgt

SEQ ID NO: 558596 - DNA, 495 bp, Homo sapiens
  misc_feature: HIJSMM301APTDH.51.71.G05.1.454.light.4.raw
cgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactcgtca

SEQ ID NO: 558597 - DNA, 514 bp, Homo sapiens
  misc_feature: HIJSMM301CNSAQ.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctactgactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtgttcggcggagggaccaagctggccgtcctaggtcagcccaaggctgccccctcggtcactctgttcccaccctcctcgaatagtaca

SEQ ID NO: 558598 - DNA, 491 bp, Homo sapiens; identical to SEQ ID NO: 536988
  misc_feature: HIJSMM301B9F37.17.21.B10.1.454.light.4.raw

SEQ ID NO: 558599 - DNA, 492 bp, Homo sapiens; identical to SEQ ID NO: 553025
  misc_feature: HIJSMM301D6I8F.41.2.A02.1.454.light.4.raw

SEQ ID NO: 558600 - DNA, 512 bp, Homo sapiens
  misc_feature: HIJSMM301ASIT1.17.2.A02.1.454.light.4.raw
cgtagactagcacgaccggtgctcgatttagactcatctacagggggggtagagaagacaggactcaggacaatctccagcatggccagcttccctctcctcctcaccctcctcactcactgtgcagggtcctgggcccagtctgtactgactcagccaccctcagcgtctgggacccccggacagagggtcaccatctcttgttctggaagcagctccaacatcgggactaatactgtaacctggttccagcacgtcccaggaacggcccccaaactcgtcatgtataattatagtcagcggccctcaggggtccctgaccgattcgctggctccaactctggcacctcagcctccctggccatcagtgggctccagtctgaggatgaggctgattattactgtgcagcatgggatgccagcctgagtagtcccgtcttcggaactgggaccaaggtcaccgtcctacgtcagcccaaggccaaccccactgtcactctgttccccgccct

SEQ ID NO: 558601 - DNA, 486 bp, Homo sapiens; identical to SEQ ID NO: 535043
  misc_feature: HIJSMM301CYSSJ.46.35.D02.1.454.light.4.raw

SEQ ID NO: 558602 - DNA, 477 bp, Homo sapiens; identical to SEQ ID NO: 535122
  misc_feature: HIJSMM301CTTIM.26.72.G06.1.454.light.4.raw

SEQ ID NO: 558603 - DNA, 473 bp, Homo sapiens; identical to SEQ ID NO: 538875
  misc_feature: HIJSMM301CE0Z9.4.75.G09.1.454.light.4.raw

SEQ ID NO: 558604 - DNA, 506 bp, Homo sapiens
  misc_feature: HIJSMM301DO2HU.15.86.H09.1.454.light.4.raw
  modified_base (497)..(497): a, c, t, g, unknown or other
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaaggacggttgggtgttcggcggagggaccaagctgaccgtcctaggtcagcccaaggcctgccccctggtcactctgttcccnccctcctcg

SEQ ID NO: 558605 - DNA, 494 bp, Homo sapiens
  misc_feature: HIJSMM301B4RXF.10.79.H02.1.454.light.4.raw
  modified_base (460)..(460): a, c, t, g, unknown or other
catagtagtgcacgaccggtgctcgatttagtgtcacacgaagggaaaggggagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatccccagacaggttcagtggcagtgggtctgggacagacttcactctcaccatcagcagactggagtctgaagattttgcagtgtattattgtcagcaatatggtaggtcacctgggacttttggccaggggaccaagctgganatcaaacgaactgtggctgcaccatctgtcttca

SEQ ID NO: 558606 - DNA, 492 bp, Homo sapiens
  misc_feature: HIJSMM301D41JM.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggttattactgcatgcaagctctacaaactccttacacttttggccaggggaccaagctggagatcaaacgaactgtgg

SEQ ID NO: 558607 - DNA, 505 bp, Homo sapiens
  misc_feature: HIJSMM301ASQ11.22.77.G11.1.454.light.4.raw
acatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtctccatcctcccggtctgcatctgttggagaaagaatcaccatcacttgtcgggcaagtcagagcattgatatccttttaaactggtatcatcagagaccagggaaggcccctaagttcctgatccatgatgcatccactctgcagagtggagtcccatccaggttcagtggcagtgggtctgggacagagttcactctcaccatcaacagtctgcagccagaggactttggaacctactattgccaacagacttacagtacccccccaccgtacggtcggacggacgaccacgtacgtacgatactaacgaaacgtacgtggcgtcgcgaccaactcttcg

SEQ ID NO: 558608 - DNA, 481 bp, Homo sapiens
  misc_feature: HIJSMM301BKDSB.17.39.D06.1.454.light.4.raw
cgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttggcagcaacttagcctggtatcagcagaacctggccaggctcccaggctcctcatgtatggtgcatctaccagggccactggtgtcccagccaggttcagtggcagtgggtctgggacagagttctctctcatcatcagcagcctgcagtctgaagattttgcggttttattactgtcagcagtataatcagtggcctccgtggacgttcggccaagggaccaaggtggaaatcaaacgaactgtgg

SEQ ID NO: 558609 - DNA, 489 bp, Homo sapiens
  misc_feature: HIJSMM301AG4YD.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcggcggagggaccgaaggtggagatacaaacgaac

SEQ ID NO: 558610 - DNA, 491 bp, Homo sapiens
  misc_feature: HIJSMM301D4OMZ.15.67.G01.1.454.light.4.raw
tctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcatcggcagtggatctggcacagatttcactctcaccatcagcagcctgcagcctgaagatttcgcaacttattactgtctacaagattacaattaccctcggacgttcggtccgacgggaccgaacggtaggaaatacaaacgaactagtggcgtgc

SEQ ID NO: 558611 - DNA, 484 bp, Homo sapiens; identical to SEQ ID NO: 535240
  misc_feature: HIJSMM301B9SOG.47.60.F05.1.454.light.4.raw

SEQ ID NO: 558612 - DNA, 501 bp, Homo sapiens; identical to SEQ ID NO: 535873
  misc_feature: HIJSMM301BAFPS.17.27.C05.1.454.light.4.raw

SEQ ID NO: 558613 - DNA, 506 bp, Homo sapiens
  misc_feature: HIJSMM301EMCT4.16.46.E02.1.454.light.4.raw
  modified_base (498)..(498): a, c, t, g, unknown or other
  modified_base (500)..(500): a, c, t, g, unknown or other
tgtactactccacgaccggtgctcgatttagactcatctacagggaaaggggggagtctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgcttcggaactgggaccaaggtcaccgtcctaggtcagcccaaggccaaccccncngtcact

SEQ ID NO: 558614 - DNA, 505 bp, Homo sapiens
  misc_feature: HIJSMM301E1CP5.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaattgagatcaaacgaactgtggctgcaccatctgtcttcatcttcccgccat

SEQ ID NO: 558615 - DNA, 491 bp, Homo sapiens; identical to SEQ ID NO: 537567
  misc_feature: HIJSMM301ERCIR.48.38.D05.1.454.light.4.raw

SEQ ID NO: 558616 - DNA, 486 bp, Homo sapiens; identical to SEQ ID NO: 537428
  misc_feature: HIJSMM301A01KB.47.62.F07.1.454.light.4.raw

SEQ ID NO: 558617 - DNA, 507 bp, Homo sapiens
  misc_feature: HIJSMM301AHYTE.43.67.G01.1.454.light.4.raw
tgtgagtagtcacgaccggtgctcgatttagagtatacatattgggtttgggggagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttatactgtcaacaatttcgtatactccgccgacgttcggccggggaccgaccgtggaaatcaaacgaactagtggctgcaccatctgtctt

SEQ ID NO: 558618 - DNA, 480 bp, Homo sapiens
  misc_feature: HIJSMM301B7U6G.52.23.C01.1.454.light.4.raw
cgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaactatttaaattggtatcagcagaaaccagggaaagcccctaaactcctgatctacgatgcatccaatttggagacaggggtcccatcaaggttcactggaagtggatctgggacacattttactttcaccatcagcggcctgcagcctgaagattttgcaacatattactgtcaacaatatgaagatctcccctcactttcggcagaggaccaaggtggagatcagacgaactgtggctgcacc

SEQ ID NO: 558619 - DNA, 502 bp, Homo sapiens
  misc_feature: HIJSMM301EEYKT.5.86.H09.1.454.light.4.raw
atcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaagctgaccgtcctaggtcagcccaaggctgcccctcgg

SEQ ID NO: 558620 - DNA, 450 bp, Homo sapiens; identical to SEQ ID NO: 540125
  misc_feature: HIJSMM301A1E6F.51.46.E02.1.454.light.4.raw

SEQ ID NO: 558621 - DNA, 485 bp, Homo sapiens
  misc_feature: HIJSMM301AGWOD.43.7.A07.1.454.light.4.raw
tgtgagtagtcacgaccggtgctcgatttagcacgtgtcgcaggggggggtctcaggaggcagcactctcgggacgtctccaccatggcctgggctctgctcctcctcagcctcctcactcagggcacaggatcgtggtctcagtctgccctgactcagcctcgctctctatccgggtctcctggacagtcagtcaccatcccctgcactggaaccagcaatgatgttggtacttataatcatgtctcctggtaccaacaatacccaggcaaggcccccaaactcatcatttatcatgtcagtgagcggccctcaggggtccctgatcgcttctctggctccaagtctggcaacacggcctccctgaccatctctgggctccagggtgaggatgaggctgaatattattgctgctcatatgctgtcatgggaggcagtttgtgggtgttcgggcggagggacccagctgaccgtcctaggtcacg

SEQ ID NO: 558622 - DNA, 495 bp, Homo sapiens; identical to SEQ ID NO: 535007
  misc_feature: HIJSMM301BVGC1.22.5.A05.1.454.light.4.raw

SEQ ID NO: 558623 - DNA, 513 bp, Homo sapiens
  misc_feature: HIJSMM301D7GNG.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctactgactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtgttcggcggagggaccaagctggccgtcctaggtcagcccaaggctgccccctcggtcactctgttcccaccctcctcgatagtaca

SEQ ID NO: 558624 - DNA, 495 bp, Homo sapiens; identical to SEQ ID NO: 535143
  misc_feature: HIJSMM301EE100.51.29.C07.1.454.light.4.raw

SEQ ID NO: 558625 - DNA, 494 bp, Homo sapiens; identical to SEQ ID NO: 534992
  misc_feature: HIJSMM301B6E7I.9.1.A01.1.454.light.4.raw

SEQ ID NO: 558626 - DNA, 520 bp, Homo sapiens
  misc_feature: HIJSMM301DDUQ6.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaacgccgtcccggacacagtggtaaccatgtggtattcggtcggacgggaccgaaactaggaccgccgtacgtcacgccgaaccgacgtcgtccccgtcccggtccgactctcgttcccc

SEQ ID NO: 558627 - DNA, 486 bp, Homo sapiens; identical to SEQ ID NO: 535043
  misc_feature: HIJSMM301D2PC6.46.35.D02.1.454.light.4.raw

SEQ ID NO: 558628 - DNA, 502 bp, Homo sapiens
  misc_feature: HIJSMM301B5G57.3.10.A10.1.454.light.4.raw
agacgcactccacgaccggtgctcgatttagcgtcgatctcaggggagagctctggggaggaactgctcagttaggacccagacggaaccatggaagccccagcgcagcttctcttcctcctgctactctggctcccagatgccactggagaaatagtgatggcgcagtctccagccaccctgtctgtgtctccaggggaaagagccaccctctcctgcagggccagtcagtctgtttataacaacttagcctggtaccaacagagacctggccaggctcccaggctcctcatgtttggtgcttccaccagggccactggtatcccagccaggttcagtggcagtgggtctgggacaggagttcactctcaccatcagcagcctgcagtctgaagtattttgctaatttatttctgtcagcagtacaataattggtcctttgacgttcggccgaaggaccaaggtaggaaactaaacgaactgtggctgcaccatctgtctt

SEQ ID NO: 558629 - DNA, 520 bp, Homo sapiens; identical to SEQ ID NO: 540293
  misc_feature: HIJSMM301C6OBE.27.23.C01.1.454.light.4.raw

SEQ ID NO: 558630 - DNA, 484 bp, Homo sapiens
  misc_feature: HIJSMM301DAGMX.10.1.A01.1.454.light.4.raw
catagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagctcctctccgacaggaataacatccggccctcagggatctcagagagattctctgcatccaggtcaggaagcacagcctccctgaccattactggactccaggctgacgacgaagctgattattactgctcagcatgggacaccggcctcagtgcgtggttttcggcggagggaccaagctgaccgtcctaggtcagaccccg

SEQ ID NO: 558631 - DNA, 503 bp, Homo sapiens
  misc_feature: HIJSMM301DNEA3.48.83.H06.1.454.light.4.raw
agtatacatacacgaccggtgctcgatttagatcacgtgcgtcgcggggggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcagggggacccaggccttggatgaggctgactatcactgtcaggcgtgggacagcaacactgcgattttcggcgggggaccaggctgaccgtcggcggtcagcccaaggctgccccctcggtcactctgttcccgccctcct

SEQ ID NO: 558632 - DNA, 492 bp, Homo sapiens; identical to SEQ ID NO: 539815
  misc_feature: HIJSMM301BA6ZD.51.81.H04.1.454.light.4.raw

SEQ ID NO: 558633 - DNA, 503 bp, Homo sapiens
  misc_feature: HIJSMM301BRQ9P.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggcgaaggctgattattactgcagctcatatacaagcaccagcactctctatgtcttcggaactgggaccaaggtcaccgtcctaggtcagcccaaggccaacccca

SEQ ID NO: 558634 - DNA, 508 bp, Homo sapiens; identical to SEQ ID NO: 536388
  misc_feature: HIJSMM301CLEXR.11.57.F02.1.454.light.4.raw

SEQ ID NO: 558635 - DNA, 505 bp, Homo sapiens
  misc_feature: HIJSMM301C1O88.8.42.D09.1.454.light.4.raw
ctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcggcggagggaccaagttgaccgtcctaggtcagcccaaggctgccccctggtcactctgttcccacct

SEQ ID NO: 558636 - DNA, 487 bp, Homo sapiens
  misc_feature: HIJSMM301D0DS8.47.46.E02.1.454.light.4.raw
agctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccaggggaaagagccaccatctcctgtagggccggtcagagtattagcatcaacttagcctggtaccagcagagacctgggcaggctaacccaggctcctcatctatgatgcgtccaccagggccactggtttcccagccaggttcagtggcagtgcgtctgggacagagttcactctcaccatcaacagcctgcagtctgaagattttgcagtttattactgtcagcagtatcataactggccgctcaccttcggccaagggacacgactggagattaaacgaactgtggctgcaccat

SEQ ID NO: 558637 - DNA, 490 bp, Homo sapiens
  misc_feature: HIJSMM301BJQTR.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactacttactcaatagatcaccttcggccaaggacaacgactagagattaaacgaacactggctgcaccaatctgt

SEQ ID NO: 558638 - DNA, 501 bp, Homo sapiens
  misc_feature: HIJSMM301B3KY8.19.78.H01.1.454.light.4.raw
tactctcgtgcacgaccggtgctcgatttagtgtgagtagtttgggtttgggggctttatttgggctctgctgctcctcactctacccactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagccccaaggccaaccccactgtcactctgttccccaccctcctccacgagagta

SEQ ID NO: 558639 - DNA, 494 bp, Homo sapiens
  misc_feature: HIJSMM301A8C98.21.27.C05.1.454.light.4.raw
tcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggagcgccaccctctcctgcacagccagtcagtctatcgctgactggttagcctggtaccagcagaaatctggccaggctcccaggctcctcatttaccgtgcatccaccagggccactggtgtcccagacaggttcagtggcggtggatttgggacagagttttctctcaccatcagcgccctacagagtgaagatgttgcagtttatttctgccagcaatataattactggcctgcgtcgacgttcggccacgggaccaaggtggaatcaaacgaactgtggctgcaccatctgtctt

SEQ ID NO: 558640 - DNA, 490 bp, Homo sapiens
  misc_feature: HIJSMM301D4M9P.48.54.E10.1.454.light.4.raw
agtatacatacacgaccggtgctcgatttagatcgtagcagaacacacaaaggggctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatttcctgcactgggaccagctccaacatcggcgtaggttatgatgtacactggtaccagcaacttccaggaacagtccccagactcctcatctatgataacaacaatcggccctcaggggtccctgaccggttctctggctccaagtctggcacctcagcctccctggccatcactgggctccagactgaggatgaggctgattattactgccagtcctatgacagcaacctgagcggttgggtgttcggcggagggaccagggtgtacccg

SEQ ID NO: 558641 - DNA, 495 bp, Homo sapiens; identical to SEQ ID NO: 553683
  misc_feature: HIJSMM301DPWLH.48.1.A01.1.454.light.4.raw

SEQ ID NO: 558642 - DNA, 493 bp, Homo sapiens
  misc_feature: HIJSMM301D5RWS.40.11.A11.1.454.light.4.raw
tctagcgactcacgaccggtgctcgatttagctacgactgcaggggcagcaagatggtgttgcagacccaggtcttcatttttctgttgctctggatctctggtgcctacggggacatcgtgatgacccagtctccagactccctggctgtgtctctgggcgagagggccaccatcaactgcaagtccagccagagtcttttatacaactccaacaagcagcactacttagcttggtaccagcagaaaccaggacagcctcctaaactgctcatttactgggcctctacccgggaatccggggtccctgaccgattcagtggcagcgggtctgggacagatttcactctgaccatcagcagcctgcaggctgaagatgtggcagtttattactgtcaaacaatattatattattccgaggacgttcggccaagggaccaaggtggaaatcaaacgaactgtggctgcaccatctgtcttcatcttcccgccat

SEQ ID NO: 558643 - DNA, 505 bp, Homo sapiens
  misc_feature: HIJSMM301C1455.26.78.H01.1.454.light.4.raw
agactatactcacgaccggtgctcgatttagtgtgagtagtttgggtttggggcagagccctggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcacttcgtcggagggaccggaggtagggaggagtacacgaacgaacgtagtggtcgtcgc

SEQ ID NO: 558644 - DNA, 494 bp, Homo sapiens; identical to SEQ ID NO: 534992
  misc_feature: HIJSMM301A31C0.9.1.A01.1.454.light.4.raw

SEQ ID NO: 558645 - DNA, 479 bp, Homo sapiens; identical to SEQ ID NO: 537163
  misc_feature: HIJSMM301CS4JO.13.73.G07.1.454.light.4.raw

SEQ ID NO: 558646 - DNA, 516 bp, Homo sapiens
  misc_feature: HIJSMM301A70MC.12.85.H08.1.454.light.4.raw
atacgacgtacacgaccggtgctcgatttagtatcactcagtcgcggggggggtcgtcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcaccatttcctgcaccggaaccaatagtgacgttggtcgttataactttgtctcctggtacaaacagcacccaggcaaagccccccaactcctgatttatgaggtcactattcggtcctcaggaatttctaatcgcttctctggttccaagtctggcaacacggcctccctgaccatctctggggtccaggctgaggacgaggctgattattactgcagttcatatacaagcacttccactctcgtggtgttcggcggtgggaccagctgaccgtcctaagtcagcccaaggctgccccctcggtcactctgttccca

SEQ ID NO: 558647 - DNA, 503 bp, Homo sapiens
  misc_feature: HIJSMM301C0AAH.8.28.C06.1.454.light.4.raw
ctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactgtggctgcaccatctgtcttcatcttcccgc

SEQ ID NO: 558648 - DNA, 504 bp, Homo sapiens; identical to SEQ ID NO: 538423
  misc_feature: HIJSMM301C7GUM.48.67.G01.1.454.light.4.raw

SEQ ID NO: 558649 - DNA, 495 bp, Homo sapiens
  misc_feature: HIJSMM301BG8GD.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgcagtttattactgtcagcagtataattactggcctcggacgttcggccgaagggaccgaaggtggaagtacaaacgaactagtggctgcaccatctgtctt

SEQ ID NO: 558650 - DNA, 479 bp, Homo sapiens
  misc_feature: HIJSMM301A8VV1.52.1.A01.1.454.light.4.raw
cgcagtacgacacgaccggtgctcgatttagacgtctcatcagggggcaggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtggggtcccatcaaggttcagtggcagtggatctgggacagaattcactctcaccatcaccagtctgcaggctgaggattttgcaacttacttctgttcaacagagttacagttccctcactttccggccctgggaccatagtggatatcaacgaactgtggctgcaccat

SEQ ID NO: 558651 - DNA, 508 bp, Homo sapiens; identical to SEQ ID NO: 553020
  misc_feature: HIJSMM301DD8BM.17.41.D08.1.454.light.4.raw

SEQ ID NO: 558652 - DNA, 487 bp, Homo sapiens; identical to SEQ ID NO: 544685
  misc_feature: HIJSMM301D0WJH.15.28.C06.1.454.light.4.raw

SEQ ID NO: 558653 - DNA, 447 bp, Homo sapiens; identical to SEQ ID NO: 535020
  misc_feature: HIJSMM301CUXTL.18.9.A09.1.454.light.4.raw

SEQ ID NO: 558654 - DNA, 523 bp, Homo sapiens
  misc_feature: HIJSMM301DSV4L.10.86.H09.1.454.light.4.raw
catagtagtgcacgaccggtgctcgatttagtgctatagacttgggtttggggagctctgcttcagctgtgagcgcagaaggcgggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacacgcccccaaactcctcatctatgaagattttacgcgaccctcagggattcctggccgattctctggctccaagtcaggcacctctgccaccctggacatccaccgggctccagaccggggacgaggccgattattactgcgcaacttgggactccaacctgactgttggggctttcggcggagggactaagttgaccgtcctacgtcagcccaaggctgccccctcggtcca

SEQ ID NO: 558655 - DNA, 486 bp, Homo sapiens
  misc_feature: HIJSMM301AQ94V.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaaacgactagtggctgcaccat

SEQ ID NO: 558656 - DNA, 479 bp, Homo sapiens
  misc_feature: HIJSMM301CVDKG.48.19.B08.1.454.light.4.raw
agtatacatacacgaccggtgctcgatttagtgagtcagtaagggggctggtcacacttcttgcaggagtcagacccactcaggacacagcatggacatgagggtccccgctcagctcctggggcttctgctgctctggctcccaggtgccagatgtgacgtccagttgacccagtctccatcctccctgtctgcatctgtgggagacagagtcaccctcacttgccgggcaagtcaggccatttccaattctttagcctggtatcagcagaaaccaggacaaactcctacactcctgatctatgatgcgtccagtttagagagtggggccccatcgaggttcagcggcagtggatcagggcaaaaaggttcactctcaccatcagcagcctgcagcctgaagattttgcaacttatactgtcaacactttaacaattaccctcataagccttcggccaagggaccaaggtggaacgta

SEQ ID NO: 558657 - DNA, 505 bp, Homo sapiens; identical to SEQ ID NO: 539978
  misc_feature: HIJSMM301BEI7D.5.86.H09.1.454.light.4.raw

SEQ ID NO: 558658 - DNA, 486 bp, Homo sapiens
  misc_feature: HIJSMM301D4W7R.41.57.F02.1.454.light.4.raw
tctatactatcacgaccggtgctcgatttagctcgatatagttgggtttggggtccaaacagagcttcagcaagcatagtgggaatctgcaccatgccctgggctctgctcctcctgaccctcctcactcactctgcagtgtcagtggtccaggcaggactgactcagccaccctcggtgtccaagggcttgagacagaccgccacactcacctgcactgggaacagctacaatgttggcaacgaaggagcagcttggctgcagcagtaccagggccaccctcccaaattgctatcatacaggaagaacaaccgcccctcggggatctccgagagattctctgcatcaacgtcaggaaacatagcctccctgaccattactggactccagcctgaggacgaggctgactattactgctcagcatgggacagcagcctcaatgtttggtgttcggcggagggaccaagctgaccgtcctaggtcacg

SEQ ID NO: 558659 - DNA, 490 bp, Homo sapiens
  misc_feature: HIJSMM301DXYHS.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgctaacttactactgtcaacagagttacagtacccccctcactttcggcggagggaccaaggcggagatcagacgaactgtggctgcaccatctgtcttcta

SEQ ID NO: 558660 - DNA, 496 bp, Homo sapiens; identical to SEQ ID NO: 536802
  misc_feature: HIJSMM301C6KHQ.5.24.C02.1.454.light.4.raw

SEQ ID NO: 558661 - DNA, 514 bp, Homo sapiens; identical to SEQ ID NO: 544770
  misc_feature: HIJSMM301C2WR9.16.66.F11.1.454.light.4.raw

SEQ ID NO: 558662 - DNA, 477 bp, Homo sapiens
  misc_feature: HIJSMM301C8FW6.52.78.H01.1.454.light.4.raw
  modified_base (425)..(425): a, c, t, g, unknown or other
cgcagtacgacacgaccggtgctcgatttagtgtgagtagtttgggtttgggctgggcctcaggaagcagcatcggaggtgcctcagccatggcatggatccctctcttcctcggcgtccttgcttactgcacaggatccgtggcctcctatgagctgactcagccacactcagtgtccgtgtccccaggacagacagccagcatcacctgctctggagatgaattggggaataaatttgcttgctggtatcaccagaagccaggccagtcccctgtcctggtcatctatcaagatgtcaagcggccctcagggatccctgagcgattctctggctccaactctgggaacacagccactctgaccatcagcgggacccaggctatggatgaggctgactattactgtcaggcgtgggacagcaanactgtggtattcggcggagggaccaagctgaccgtcctaggtcagcccaagg

SEQ ID NO: 558663 - DNA, 485 bp, Homo sapiens; identical to SEQ ID NO: 535501
  misc_feature: HIJSMM301D0O01.3.10.A10.1.454.light.4.raw

SEQ ID NO: 558664 - DNA, 520 bp, Homo sapiens; identical to SEQ ID NO: 535686
  misc_feature: HIJSMM301A379T.41.19.B08.1.454.light.4.raw

SEQ ID NO: 558665 - DNA, 522 bp, Homo sapiens
  misc_feature: HIJSMM301DZFRR.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccaagtgacacttgggtgttcggcggagggaccaggctgaccgtcctaggtcagcccaaggctgccccctcggtcactctgttcccaccct

SEQ ID NO: 558666 - DNA, 495 bp, Homo sapiens
  misc_feature: HIJSMM301BFKEX.43.49.E05.1.454.light.4.raw
tgtgagtagtcacgaccggtgctcgatttagagcgactagcaacacacaaagggggaagagctgctcagttaggacccagagggaaccatggaaaccccagcgcagcttctcttcctcctgctactctggctcccagataccaccggagaaattgtgttgacgcagtctccaggcaccgtgtctttgtctccaggggaaagagccaccttctcttgcagggccagtcagagtgttagcagcaactacttagcctggtaccagcagaaacctggccaggctcccaggctcctcatctatggtgcatccaccagggccactggcatcccagacagattcagtggcactgggtctgggacagacttcactctcaccatcagcagactggaacctgaagattttgcaatttattactgtcagcagtatgcctggtcgcctccggccctcactttcggcggagggaccaaggtggagatcaaacgaactgtggctgcaca

SEQ ID NO: 558667 - DNA, 494 bp, Homo sapiens
  misc_feature: HIJSMM301AW6GQ.41.59.F04.1.454.light.4.raw
tctatactatcacgaccggtgctcgatttagtacacacacttagggattgggggagtcagacccagtcaggacacaacatggacatgagggtccccgctcagctcctggggctcctgctgctctggttcccaggttcccgatgcggcatccagatgacccagtctccatctttcgtgtctgcatctataggagacagagtcaccatcacttgtcgggcgagtcaggatattaggacgtggttagcctggtatcgacagagaccgggaagagcccctgaactcctcgtctatgatgcatccactttacatcgtggggtcccatcacggttcagcggcagtggatctgggacagacttcagtctcaccatcagtaccctgcagcctgacgattttgcaatttattttgtcaacaggctaataggttccctcaaacattcggccctgggaccagagtggatttgaagcgaactgtggctgcaccatctgtcttcatt

SEQ ID NO: 558668 - DNA, 488 bp, Homo sapiens
  misc_feature: HIJSMM301DH3UX.3.19.B08.1.454.light.4.raw
agacgcactccacgaccggtgctcgatttagtgagtcagtaagggggcaggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtggggtcccatcaaggttcagtggcagtggatctgggacagatttcactctcaccatcagtagtctacaacctgaagattttgcaacttactactgtcaacagagttacgatacccctccgctcactttcggcggagggaccaaggtggagatcaaacgaactgtggctgcaccatctgt

SEQ ID NO: 558669 - DNA, 507 bp, Homo sapiens
  misc_feature: HIJSMM301ENH2A.21.22.B11.1.454.light.4.raw
tcgtcgctcgcacgaccggtgctcgatttagacgacagctcagggtggggtcaaaaacccggggaggggggtctgatttgcatggatggactctccccctctcagagtacgaagagagggagagatctgggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattact

SEQ ID NO: 558670 - DNA, 489 bp, Homo sapiens
  misc_feature: HIJSMM301APSF7.46.35.D02.1.454.light.4.raw
  modified_base (462)..(462): a, c, t, g, unknown or other
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccgaggggaccaagctgganatcaaacgactacggtggctgcaccat

SEQ ID NO: 558671 - DNA, 444 bp, Homo sapiens; identical to SEQ ID NO: 539971
  misc_feature: HIJSMM301C5D1Q.8.73.G07.1.454.light.4.raw
  modified_base (426)..(426): a, c, t, g, unknown or other

SEQ ID NO: 558672 - DNA, 480 bp, Homo sapiens; identical to SEQ ID NO: 535291
  misc_feature: HIJSMM301AMDWW.22.59.F04.1.454.light.4.raw

SEQ ID NO: 558673 - DNA, 499 bp, Homo sapiens
  misc_feature: HIJSMM301ETTQS.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggtccaagggaccgaacggtggagtatcagacgaactgtggctg

SEQ ID NO: 558674 - DNA, 507 bp, Homo sapiens
  misc_feature: HIJSMM301BNPVB.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggagggaccaagggtggagatcaaacgaactgtggctgcaccatctgtt

SEQ ID NO: 558675 - DNA, 500 bp, Homo sapiens; identical to SEQ ID NO: 548335
  misc_feature: HIJSMM301EAJ7Z.52.55.E11.1.454.light.4.raw

SEQ ID NO: 558676 - DNA, 491 bp, Homo sapiens
  misc_feature: HIJSMM301CB1D6.49.73.G07.1.454.light.4.raw
agtcgagagacacgaccggtgctcgatttagctctacgctcagggcacgaccggtgctcgatttagtatgctagtatgggcacgaccggtgctcgatttagatctactgacagggggctggggtctcaggaggcagcgctctcaggacgtcaccaccatggcctgggctctgctcctcctcaccctcctcactcagggcacagggtcctgggcccagtctgccctgactcagccgccctccgcgtccgggtctcctggacagtctgtcaccatctcctgcactggaaccagcagtgacgttggtgattataactatgtctcctggtaccaacagtacccaggcaaagcccccagactcatgatttatgcggtcagtaagcggccctcaggggtccctgatcgcttctctggctccaagtctggcaacacggcctccctgaccgtctctgggctccgggctgaagatgaggctgattatttctgcagctcat

SEQ ID NO: 558677 - DNA, 514 bp, Homo sapiens
  misc_feature: HIJSMM301C95TO.15.76.G10.1.454.light.4.raw
tctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccgccctcctcgctacg

SEQ ID NO: 558678 - DNA, 498 bp, Homo sapiens
  misc_feature: HIJSMM301B2MVX.48.87.H10.1.454.light.4.raw
agtatacatacacgaccggtgctcgatttagcagtactgcgttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaagctgaccgtcctaggtcagcccaaggctcg

SEQ ID NO: 558679 - DNA, 504 bp, Homo sapiens
  misc_feature: HIJSMM301A745O.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctcggtcactctgttcccccctcctcg

SEQ ID NO: 558680 - DNA, 494 bp, Homo sapiens; identical to SEQ ID NO: 534992
  misc_feature: HIJSMM301BS4D6.9.1.A01.1.454.light.4.raw

SEQ ID NO: 558681 - DNA, 503 bp, Homo sapiens; identical to SEQ ID NO: 540136
  misc_feature: HIJSMM301AQT9I.19.10.A10.1.454.light.4.raw

SEQ ID NO: 558682 - DNA, 444 bp, Homo sapiens; identical to SEQ ID NO: 537971
  misc_feature: HIJSMM301CJQM8.2.76.G10.1.454.light.4.raw

SEQ ID NO: 558683 - DNA, 502 bp, Homo sapiens
  misc_feature: HIJSMM301B6OZU.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggccccaaaattggtcatctatgaagacgacaaacgaccctccgggatccctgagagattctctggctccagctcagggactatggccaccttgactatcagtgggcccaagtggaggatgaagctgactactactgttactcaatagagaacagtgataatttctgggtgttcggcggagggaccaaactgaccgtcctaggtcagccaaggctgccccctcggtcactctgtt

SEQ ID NO: 558684 - DNA, 479 bp, Homo sapiens; identical to SEQ ID NO: 540947
  misc_feature: HIJSMM301D8Q0V.52.1.A01.1.454.light.4.raw

SEQ ID NO: 558685 - DNA, 490 bp, Homo sapiens; identical to SEQ ID NO: 535526
  misc_feature: HIJSMM301AVMSH.26.78.H01.1.454.light.4.raw

SEQ ID NO: 558686 - DNA, 454 bp, Homo sapiens; identical to SEQ ID NO: 535005
  misc_feature: HIJSMM301EMK30.19.86.H09.1.454.light.4.raw

SEQ ID NO: 558687 - DNA, 520 bp, Homo sapiens; identical to SEQ ID NO: 551527
  misc_feature: HIJSMM301CKWX7.7.86.H09.1.454.light.4.raw

SEQ ID NO: 558688 - DNA, 494 bp, Homo sapiens
  misc_feature: HIJSMM301BRTMI.47.78.H01.1.454.light.4.raw
agctcacgtacacgaccggtgctcgatttagtgtgagtagtttgggtttggggtgatcaggactcctcagttcaccttctcacaatgaggctccctgctcagctcctggggctgctaatgctctgggtcccagatccagtggggatgttgtgatgactcagtctccactctccctgtccgtcacccttgcacagccggcctccatctcctgttggtctggtcaaggcctcgaatacagtgatggaaacacctgcttgaattgctttcaccagaggccaggcccatctccaaggcgcctaatttataagctttctaaccgggactctggggtcccagacagattcagcggcagtggcactgatgtcacactgacaatcagcagggtggaggctgaggatgttggggtttgttcctccatgcaaggtacacactggccttttggcctaggggaccaacctggagatcaaatgaactgtggctgcaccatctgtctt

SEQ ID NO: 558689 - DNA, 480 bp, Homo sapiens
  misc_feature: HIJSMM301DKNI6.5.12.B01.1.454.light.4.raw
atcagacacgcacgaccggtgctcgatttagtagtgtagattccgcggggggcccactgttagggctcaggggctgtgtccaccatggcctggactcttctccttctcgtgctcctctctcactgcacaggttccctctcccagcctgtgctgactcagccatcttcccattctgcatcttctggagcatcagtcagactcacctgcatgctgagcagtggcttcagtgttggggacttctggataaggatatcagaggctgattgcagagtcaccttatagatcacttcatagacacagggaacagaagacacagacaactgaggaagcaaagtttaaattctactcacgtttgatttccaccttggtcccttggccgaacgtcctcgggtgttcggcggagggaccaagctgaccgtcctaggtcagcccaaggctgccccctcggtcactctgttcccaccctcctccgtgtctgat

SEQ ID NO: 558690 - DNA, 489 bp, Homo sapiens; identical to SEQ ID NO: 535139
  misc_feature: HIJSMM301DA4VT.14.55.E11.1.454.light.4.raw

SEQ ID NO: 558691 - DNA, 509 bp, Homo sapiens; identical to SEQ ID NO: 539359
  misc_feature: HIJSMM301BV2PB.47.85.H08.1.454.light.4.raw

SEQ ID NO: 558692 - DNA, 477 bp, Homo sapiens
  misc_feature: HIJSMM301BP3ZU.52.1.A01.1.454.light.4.raw
cgcagtacgacacgaccggtgctcgatttagacgtctcatcagggggcaggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtggggtcccatcaaggttcagtggcagtggatctgggacagaattcactctcaccatcaccagtctgcaggctgaggattttgcaacttacttctgtcaacagagttacagttccctcactttcggccctgggaccatagtggatatcaaacgaactgtggctgcaccc

SEQ ID NO: 558693 - DNA, 486 bp, Homo sapiens; identical to SEQ ID NO: 535385
  misc_feature: HIJSMM301AW4DN.19.71.G05.1.454.light.4.raw

SEQ ID NO: 558694 - DNA, 487 bp, Homo sapiens
  misc_feature: HIJSMM301A5G43.52.27.C05.1.454.light.4.raw
cgcagtacgacacgaccggtgctcgatttagacgcgatcgaagggtttggggagtctcagtcaggacacagcatggacatgagggtccccgctcagctcctggggctcctgctactctggctccgaggtgccagatgtgacacccagatgacccagtctccatcctccctgtctgcatctgtaggagacagagtcaccatcacgtgccgggcaagtcagagcattggcaggtatttaaattggtatcaacagaaaccagggaaagcccctaggctcctgatctatgctgcatcccgtttgcaaagtgggtcccgtcaaggttcagtggccgtggatctgggacagatttcactctcaccatcagcagtctccaacctgaagattttgcaatttactactgtcaacagagtgacaatacccctcagactttcggccctgggaccagagtggatatcaacgaactgtggcgtgcaccatctgtcttcat

SEQ ID NO: 558695 - DNA, 493 bp, Homo sapiens; identical to SEQ ID NO: 535548
  misc_feature: HIJSMM301BIXO2.51.81.H04.1.454.light.4.raw

SEQ ID NO: 558696 - DNA, 468 bp, Homo sapiens
  misc_feature: HIJSMM301DFDYW.52.2.A02.1.454.light.4.raw
cgcagtacgacacgaccggtgctcgatttagactcatctacagggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattaacatgtatctgaattggtatcagcagaaaccagggaaagcccctaaactcctgatcctcgatgcatccaatttggaaacaggggtcccatcaaggttcagtggaagtggctctgggacagattttactttcaccatcgccagactgcagcctgaagatattgcaacatattactgtcaacagtatgataatctcccgctcactttcggcggagggaccaaggtggagatcagacgaactgtgg

SEQ ID NO: 558697 - DNA, 501 bp, Homo sapiens
  misc_feature: HIJSMM301BC7DN.48.78.H01.1.454.light.4.raw
agtatacatacacgaccggtgctcgatttagtgtgagtagtttgggtttgggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaatatgcttattggtaccagcagaagtcaggccaggcccctgtgctggtcatctttgaggacaacaaacgaccctccgggatccctgagagattctctggctccagctcagggacaatggccaccttgactatcaatgggcccaggtggacgatgaggctgactactactgttcctcaacagacagtagtggtgatcgagggctgttcggcggagggaccaagctgaccgtcctaagtcagcccaaggctgccccctcggtcact

SEQ ID NO: 558698 - DNA, 494 bp, Homo sapiens
  misc_feature: HIJSMM301DYKWG.12.23.C01.1.454.light.4.raw
atacgacgtacacgaccggtgctcgatttagtacacgtgattagggattgggggaggaactgctcagttaggacccagacggaaccatggaagccccagcacagcttctcttcctcctgctactctggctcccagataccactggagaaatagtgatgaagcagtctccagccaccctgtctgtgtctccaggggaaagagccaccctctcctgcagggccagtcagagtgttaatagcgacttagcctggtaccagcagatacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcagcagtataataactggttcctgctcactttcggcggggggaccgaaggtggagatcaaacgaactgtggctgcaccatctgt

SEQ ID NO: 558699 - DNA, 488 bp, Homo sapiens; identical to SEQ ID NO: 536554
  misc_feature: HIJSMM301AE6E2.26.37.D04.1.454.light.4.raw

SEQ ID NO: 558700 - DNA, 503 bp, Homo sapiens
  misc_feature: HIJSMM301AYURE.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccacttcggccctcggaccaagtaggatatcaacgaactgtggctgcaccatctgtctt

SEQ ID NO: 558701 - DNA, 486 bp, Homo sapiens; identical to SEQ ID NO: 537144
  misc_feature: HIJSMM301A2CIA.46.35.D02.1.454.light.4.raw

SEQ ID NO: 558702 - DNA, 447 bp, Homo sapiens; identical to SEQ ID NO: 535020
  misc_feature: HIJSMM301BLIO0.18.9.A09.1.454.light.4.raw

SEQ ID NO: 558703 - DNA, 491 bp, Homo sapiens; identical to SEQ ID NO: 542310
  misc_feature: HIJSMM301B278T.22.65.F10.1.454.light.4.raw

SEQ ID NO: 558704 - DNA, 494 bp, Homo sapiens; identical to SEQ ID NO: 535276
  misc_feature: HIJSMM301D8I9G.16.6.A06.1.454.light.4.raw

SEQ ID NO: 558705 - DNA, 484 bp, Homo sapiens; identical to SEQ ID NO: 535240
  misc_feature: HIJSMM301AT0JS.47.60.F05.1.454.light.4.raw

SEQ ID NO: 558706 - DNA, 487 bp, Homo sapiens; identical to SEQ ID NO: 540408
  misc_feature: HIJSMM301DNVHH.41.33.C11.1.454.light.4.raw

SEQ ID NO: 558707 - DNA, 499 bp, Homo sapiens; identical to SEQ ID NO: 547591
  misc_feature: HIJSMM301ETWSJ.43.34.D01.1.454.light.4.raw

SEQ ID NO: 558708 - DNA, 517 bp, Homo sapiens; identical to SEQ ID NO: 540154
  misc_feature: HIJSMM301BLY56.41.55.E11.1.454.light.4.raw

SEQ ID NO: 558709 - DNA, 498 bp, Homo sapiens
  misc_feature: HIJSMM301DWU9J.12.18.B07.1.454.light.4.raw
atacgacgtacacgaccggtgctcgatttagtcgctgcgtaagggggaggaactgctcagttaggacccagagggaaccatggaagccccagctcagcttctcttcctcctgctactctggctcccagataccaccggagaaattgtgttgactcagtctccagccaccctgtctttgtctccaggggaaagagcaaccctctcctgcagggccagtcagagtgttaacagatacttagcctggtaccagcagagacctggccaggctcccaggctcctcatctatgatacattgaagagggccactggcatctcaggcagattcaatggcagtgggtctgggacagacttcactctcaccctcaccagcctagagcctgaagattttggaatttattactgtcaacagcgtagcaactggcctcccactttcgacggagggaccaaggtggagatcaagcgaactgtggctgcaccatctgtcttcatcttcccgcc

SEQ ID NO: 558710 - DNA, 490 bp, Homo sapiens
  misc_feature: HIJSMM301D57ER.48.14.B03.1.454.light.4.raw
agtatacatacacgaccggtgctcgatttagtgtgagtagttccgcggggagggggtcaggctggaactgaggagcaggtgggggcacttctccctctaacactctcccctgttgaagctctttgtgatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaagtaaaaatggaaacatttacttacattggtttcaacagaggccaggccagtctccaaggcgcctgatttatgacgtttttaaacgggagtctggggtcccagacagattcagcggcagtgggtcagacactgacttcacactgagaatcagcaggttgaggctgaggatgttggcacttatta

SEQ ID NO: 558711 - DNA, 488 bp, Homo sapiens
  misc_feature: HIJSMM301EPUME.40.83.H06.1.454.light.4.raw
tctagcgactcacgaccggtgctcgatttagatcacgtgcgtcgcggggcaaaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttcagcatgggacggcagcctcagtgaatgggtgttcggcggagggaccaaactgtccgtcctaggtcagaccccg

SEQ ID NO: 558712 - DNA, 477 bp, Homo sapiens; identical to SEQ ID NO: 535506
  misc_feature: HIJSMM301A2B8Z.7.67.G01.1.454.light.4.raw

SEQ ID NO: 558713 - DNA, 496 bp, Homo sapiens; identical to SEQ ID NO: 545011
  misc_feature: HIJSMM301C67ED.22.86.H09.1.454.light.4.raw

SEQ ID NO: 558714 - DNA, 471 bp, Homo sapiens; identical to SEQ ID NO: 536384
  misc_feature: HIJSMM301DA6YA.18.76.G10.1.454.light.4.raw

SEQ ID NO: 558715 - DNA, 497 bp, Homo sapiens; identical to SEQ ID NO: 535286
  misc_feature: HIJSMM301EVOVU.18.59.F04.1.454.light.4.raw

SEQ ID NO: 558716 - DNA, 493 bp, Homo sapiens; identical to SEQ ID NO: 535047
  misc_feature: HIJSMM301C0ASW.16.53.E09.1.454.light.4.raw

SEQ ID NO: 558717 - DNA, 497 bp, Homo sapiens; identical to SEQ ID NO: 542419
  misc_feature: HIJSMM301C7KN4.22.14.B03.1.454.light.4.raw

SEQ ID NO: 558718 - DNA, 502 bp, Homo sapiens
  misc_feature: HIJSMM301D1M7S.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctggtcagcccaaggctgccccctcggtc

SEQ ID NO: 558719 - DNA, 512 bp, Homo sapiens
  misc_feature: HIJSMM301ASN46.41.30.C08.1.454.light.4.raw
tctatactatcacgaccggtgctcgatttagtctgacgtcaaagggaaaggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgattaccatctcctgctctgggatcaacagcgaccttggtggttataactatgtgtcctggtaccaacaatatccaggcaaacccccaaagtcatcatttatgatgtcggtagtcggccctccggggtctctagtcgcttctctggctccaagtctggcaacacggcctccctgaccatctctgggctccaggctgaggacgaggctgactattactgcagttcatatacaagcagcagcactggagtcttcggaactgggaccagggtcaccgtcctaggtcagcccaaggccaaccccactgtcactctcg

SEQ ID NO: 558720 - DNA, 487 bp, Homo sapiens
  misc_feature: HIJSMM301EWTTY.4.57.F02.1.454.light.4.raw
agcactgtagcacgaccggtgctcgatttagctcgatatagttgggtttgggggaggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtgggtcccatcaagattcagtggcagtggatctgggacagatttcactctcaccatcagtagtctacaacctgaaggttttgcaacttactactgtcaacagagttacgatacccctccgctcactttcggcggagggaccaaggtggagatcaaacgaactgtggctgcacc

SEQ ID NO: 558721 - DNA, 513 bp, Homo sapiens
  misc_feature: HIJSMM301C9A7A.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaaggctgaccgtcttaagtcagcccaaggctgccccctggtcactctcgtcccaccctcct

SEQ ID NO: 558722 - DNA, 492 bp, Homo sapiens
  misc_feature: HIJSMM301C2AT2.43.72.G06.1.454.light.4.raw
tgtgagtagtcacgaccggtgctcgatttagctacgactgcaagggaaaggggagagctgctcagttaggacccagagggaaccatggaaaccccagcgcagcttctcttcctcctgctactctggctcccagatgccaccggagcaattgtgttgacgcagtctccaggcaccctgtctttgtctccaggagaaacagccaccctctcctgccgggccagtcagagtgttagagaagactacttagcctggtaccagcaaaaacctggccaggctcccaggctcctcatcaatggtgcatccagtagggccactggcatcccagacaggttcagtggcagtgggtctgcgacagacttcactctcattatcagcagactggagcctgaggactttgcagtgtatttctgtcaacaatatggtagctcaccgtacacttttggccaggggaccaagctagaaatcaaacgaactgtggctgcaccatctgtt

SEQ ID NO: 558723 - DNA, 507 bp, Homo sapiens
  misc_feature: HIJSMM301A2AMT.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggtcggagggaccgaaataagaggtcgaaacgaactagtggcgtgcaccactctcgtcttc

SEQ ID NO: 558724 - DNA, 447 bp, Homo sapiens
  misc_feature: HIJSMM301CW65C.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaactagtttgggtgtttgggtgttcgggcggagggaccaagctgaccgtctaagtcagcccaaggctcgccccctcggtcactctcgttcccgccctcctccgtgtctgat

SEQ ID NO: 558725 - DNA, 498 bp, Homo sapiens
  misc_feature: HIJSMM301CR4HJ.9.81.H04.1.454.light.4.raw
tgatacgtctcacgaccggtgctcgatttagtagtgtagattcgcggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtgcttataactatgtctcctggtaccaacagcacccaggcaaagtccccaaactcatgatttatgaggtcaataagcggccctctggggtccctgatcgcttctctggctccaagtctggcaacacggcctcctgaccgtctctgggctccaggctgacgatgaggctgattattactgcagctcatatgcaggcaccacaatgtcttcggaagtgggaccacggtcaccgtcctaggtcagcccaaggccaacccactgtcact

SEQ ID NO: 558726 - DNA, 494 bp, Homo sapiens
  misc_feature: HIJSMM301A03EE.43.72.G06.1.454.light.4.raw
tgtgagtagtcacgaccggtgctcgatttagctacgactgcaagggaaaggggtgggcctcaggaagcagcatcggaggtgcctcagccatggcatggatccctctcttcctcggcgtccttgcttactgcacaggatccgtggccgcctatgagttgactcagccaccctcagtgtccgtgtccccaggacagacagccagcatcacctgctctggagataaattgggggataaatatgcctcctggtatcagcagaagccaggcgagtcccctgtgttggtcatctatcaagatgacaaacggccctcagggatccctgagcgattctctggctccaactctgggaacacagccactctgaccatcagcgggacccaggctatggatgaggctgacttttactgtcaggcgtgggacaccaacactgtggttttcggcggagggaccaagctgaccgtcctaggtcagcccaaggctgccccctcggtcact

SEQ ID NO: 558727 - DNA, 496 bp, Homo sapiens; identical to SEQ ID NO: 535541
  misc_feature: HIJSMM301DBVGH.3.33.C11.1.454.light.4.raw

SEQ ID NO: 558728 - DNA, 489 bp, Homo sapiens; identical to SEQ ID NO: 536663
  misc_feature: HIJSMM301B3P8C.16.72.G06.1.454.light.4.raw

SEQ ID NO: 558729 - DNA, 486 bp, Homo sapiens; identical to SEQ ID NO: 538200
  misc_feature: HIJSMM301A1NJY.21.55.E11.1.454.light.4.raw

SEQ ID NO: 558730 - DNA, 508 bp, Homo sapiens; identical to SEQ ID NO: 554667
  misc_feature: HIJSMM301CBY3I.2.21.B10.1.454.light.4.raw

SEQ ID NO: 558731 - DNA, 488 bp, Homo sapiens
  misc_feature: HIJSMM301ENZTM.47.36.D03.1.454.light.4.raw
agctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacttgtcgggcgagtcagggtattagcaactggttagcctggtatcaacagaaaccagggaaagcccctaacctcctcatctctactgcatccactttgcaaagtggggtcccatcaaggttcagcggcagtggatctgggacagatttcactctcactatcagcagcctgcagcctgaagatttggaacttattattgtcaacagggtaacagtttcccgctcaccttcggcggagggaccaaggtggagatgaaaagaactgtggctgcaccat

SEQ ID NO: 558732 - DNA, 504 bp, Homo sapiens; identical to SEQ ID NO: 546705
  misc_feature: HIJSMM301DAGLH.5.86.H09.1.454.light.4.raw

SEQ ID NO: 558733 - DNA, 444 bp, Homo sapiens; identical to SEQ ID NO: 535411
  misc_feature: HIJSMM301BSLV9.8.73.G07.1.454.light.4.raw

SEQ ID NO: 558734 - DNA, 492 bp, Homo sapiens
  misc_feature: HIJSMM301EHCCZ.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaagggaccaaagtggacatcaagcgaactgtggctgcaccactctgtt

SEQ ID NO: 558735 - DNA, 494 bp, Homo sapiens; identical to SEQ ID NO: 534992
  misc_feature: HIJSMM301ED970.9.1.A01.1.454.light.4.raw

SEQ ID NO: 558736 - DNA, 480 bp, Homo sapiens; identical to SEQ ID NO: 540601
  misc_feature: HIJSMM301EJH39.40.21.B10.1.454.light.4.raw

SEQ ID NO: 558737 - DNA, 510 bp, Homo sapiens
  misc_feature: HIJSMM301EPMB9.40.48.E04.1.454.light.4.raw
tctagcgactcacgaccggtgctcgatttagagagcgtcacagagagaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcgccatctcctgcactggaaccaataatgacgttggtggttacaactatgtctcctggtaccaacaatacccaggcaaagcccccaaactcctgatttatgaggtcagtaagcggccctcaggggtccctgatcgcttctctggctccaagtctgtcaacacggcctccctgaccgtctctgggctccaggctgaggatgaggctgtttactactgcagctcatatgcaggcagcaataatttggtgttcggcgggggaccaaggctgaccgtcctaggtcagcccaaggctgccccctcggtcta

SEQ ID NO: 558738 - DNA, 485 bp, Homo sapiens; identical to SEQ ID NO: 544818
  misc_feature: HIJSMM301CYPZ7.13.36.D03.1.454.light.4.raw

SEQ ID NO: 558739 - DNA, 490 bp, Homo sapiens; identical to SEQ ID NO: 541141
  misc_feature: HIJSMM301A6SEI.47.38.D05.1.454.light.4.raw

SEQ ID NO: 558740 - DNA, 519 bp, Homo sapiens
  misc_feature: HIJSMM301EFN2D.5.27.C05.1.454.light.4.raw
atcagacacgcacgaccggtgctcgatttagacgcgatcgaagggtttgggggtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaacccactgtcactctgttcccgcctcctccgtgt

SEQ ID NO: 558741 - DNA, 485 bp, Homo sapiens; identical to SEQ ID NO: 542261
  misc_feature: HIJSMM301AZ1YL.26.78.H01.1.454.light.4.raw

SEQ ID NO: 558742 - DNA, 522 bp, Homo sapiens
  misc_feature: HIJSMM301AN3H3.3.4.A04.1.454.light.4.raw
agacgcactccacgaccggtgctcgatttagagtagtgatcaggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaaccgggactctggggtcccagacagattcagcggcagtgggtcaggcactgatttcacactgaaaatcagcagggtggaggctgaggatgttggggtttattactgcatgcaaggtacacactggcctccgacgttcggccgacggggaccgaaggtggaaagtacaaacgaaacgtaacgtggtcgtcgtcgaccaacacttcgtcgttt

SEQ ID NO: 558743 - DNA, 507 bp, Homo sapiens; identical to SEQ ID NO: 538702
  misc_feature: HIJSMM301AQYUO.11.57.F02.1.454.light.4.raw

SEQ ID NO: 558744 - DNA, 511 bp, Homo sapiens
  misc_feature: HIJSMM301BPUQ4.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaaccccactcgtcactctgttcccta

SEQ ID NO: 558745 - DNA, 522 bp, Homo sapiens
  misc_feature: HIJSMM301B6H5Z.27.23.C01.1.454.light.4.raw
  modified_base (506)..(506): a, c, t, g, unknown or other
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcgcgccaacgctcgcccctcggtcnctctcgttcccaccct

SEQ ID NO: 558746 - DNA, 502 bp, Homo sapiens
  misc_feature: HIJSMM301DP859.52.34.D01.1.454.light.4.raw
cgcagtacgacacgaccggtgctcgatttagatcgtctgtgttgggtttgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtattagcaactacttagcctggtaccaacagaaacctggccaggctcccaggctcctcatctatgatgcgtccaacagggccactggcatcccagccaggttcagtggcggtgggtctgggacagacttcactctcaccatcagcagcctagagcctgaagtattttgctagtttattactgtcagcagcgtagcaactggcctccgatcaccttcggccaagggacacgactggagattaaacgaactgtggctgcaccatctgtcttcatt

SEQ ID NO: 558747 - DNA, 444 bp, Homo sapiens; identical to SEQ ID NO: 534993
  misc_feature: HIJSMM301BZJ14.5.9.A09.1.454.light.4.raw

SEQ ID NO: 558748 - DNA, 462 bp, Homo sapiens; identical to SEQ ID NO: 554397
  misc_feature: HIJSMM301DSS9M.51.1.A01.1.454.light.4.raw

SEQ ID NO: 558749 - DNA, 494 bp, Homo sapiens; identical to SEQ ID NO: 534992
  misc_feature: HIJSMM301D08T1.9.1.A01.1.454.light.4.raw

SEQ ID NO: 558750 - DNA, 506 bp, Homo sapiens; identical to SEQ ID NO: 553862
  misc_feature: HIJSMM301BFKF9.10.88.H11.1.454.light.4.raw

SEQ ID NO: 558751 - DNA, 497 bp, Homo sapiens
  misc_feature: HIJSMM301BBIUF.11.59.F04.1.454.light.4.raw
cgagagataccacgaccggtgctcgatttagtacacacacttagggattgggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagcccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctactcttttctcttcggaactgggaccacggtcacgtcctaggtcagcccaaggccaaccccactgtcactctgttcccaccctcctcgtatctctcg

SEQ ID NO: 558752 - DNA, 521 bp, Homo sapiens; identical to SEQ ID NO: 549643
  misc_feature: HIJSMM301D7CKM.10.86.H09.1.454.light.4.raw

SEQ ID NO: 558753 - DNA, 496 bp, Homo sapiens
  misc_feature: HIJSMM301BB46Z.41.53.E09.1.454.light.4.raw
tctatactatcacgaccggtgctcgatttagagagagtgtgttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggagggaccaaggctgaccgtcctaggtcagcccaa

SEQ ID NO: 558754 - DNA, 486 bp, Homo sapiens; identical to SEQ ID NO: 535043
  misc_feature: HIJSMM301AIXJM.46.35.D02.1.454.light.4.raw

SEQ ID NO: 558755 - DNA, 495 bp, Homo sapiens; identical to SEQ ID NO: 535007
  misc_feature: HIJSMM301B66LG.22.5.A05.1.454.light.4.raw

SEQ ID NO: 558756 - DNA, 480 bp, Homo sapiens
  misc_feature: HIJSMM301AH273.48.27.C05.1.454.light.4.raw
agtatacatacacgaccggtgctcgatttagacgcgatcgaagggtttggggtgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagcccaaggc

SEQ ID NO: 558757 - DNA, 479 bp, Homo sapiens; identical to SEQ ID NO: 536050
  misc_feature: HIJSMM301D7SPA.5.73.G07.1.454.light.4.raw

SEQ ID NO: 558758 - DNA, 479 bp, Homo sapiens
  misc_feature: HIJSMM301BTS84.41.68.G02.1.454.light.4.raw
tctatactatcacgaccggtgctcgatttagtcgatagtgaagggaaagggggagtcagtcccaaccaggacacagcatggacatgagggtccctgctcagctcctggggctcctgctgctctggctctcaggtgccagatgtgacatccagatgacccagtctccaacctccctgtctgcatctgtaggagacagagtcaccatcacttgccaggccagtcaggacattagcaactatttaaattggtatcagcagaaaccagggaaagcccctaagctcctgatctacgatgcatccaatttggaatcaggggtcccatcaaggttcagtggaagtggatctgggacagattttactttcaccatcaccagcctgcagcctgaagatattgcaacatattactgtcaacagtatgataatctccctccactttcggcggagggaccaaggtggagatcaaacgaactgtgctgcacc

SEQ ID NO: 558759 - DNA, 509 bp, Homo sapiens
  misc_feature: HIJSMM301DTAEU.10.27.C05.1.454.light.4.raw
catagtagtgcacgaccggtgctcgatttagacgcgatcgaaggggtttggggggggtcgacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggggtttctagtcgcttctctgcctccaagtctggcaacacggcctccctgacaatctctgggctccaggctgacgacgaggctgaatattactgcagctcatatgtagatggtgcctcttttcaaggttttcggcggagggaccaggctgaccgtcctaagtcagcccaaggctgccccctcggt

SEQ ID NO: 558760 - DNA, 517 bp, Homo sapiens
  misc_feature: HIJSMM301CICTE.14.78.H01.1.454.light.4.raw
cgtctagtaccacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgcaactaatggtgagattgggacttataaccttgtctcctggtaccaacaacatccagacaaacgcccccaaactcatcatttatgagaccactaagcggccctcaggggtttctgatcgcttctctgcctccaagtctggccacacggcctccctgacaatctctgggctccagactgaggacgagggtgattattactgctgctcatacggaggactagaactttgctattcggcggagggaccaagttgaccgtcctaagtcagccaaggctgccccctcggtcactctgttcccccg

SEQ ID NO: 558761 - DNA, 502 bp, Homo sapiens; identical to SEQ ID NO: 543695
  misc_feature: HIJSMM301DBUEO.19.78.H01.1.454.light.4.raw

SEQ ID NO: 558762 - DNA, 489 bp, Homo sapiens; identical to SEQ ID NO: 536663
  misc_feature: HIJSMM301CNIEH.16.72.G06.1.454.light.4.raw

SEQ ID NO: 558763 - DNA, 522 bp, Homo sapiens; identical to SEQ ID NO: 538091
  misc_feature: HIJSMM301AXORH.27.23.C01.1.454.light.4.raw

SEQ ID NO: 558764 - DNA, 495 bp, Homo sapiens
  misc_feature: HIJSMM301CGEJU.43.82.H05.1.454.light.4.raw
tgtgagtagtcacgaccggtgctcgatttagtcgagctctctcgcggggagcttcagctgtgggtagagaagacaggactcaggacaatctccagcatggccagcttccctctcctcctcgccctcctcactcactgtgcagggtcctgggcccagtctgtcctgactcagccaccctcagcgtctgggacccccgggcagagggtcaccatctcttgttctggaagcagctccaacatcggaagtaatactgtaaactggtaccagcagctcccaggaacggcccccaaactcctcatctacagtattaatcagcggccctcagggatccctgaccgattctctggctccaagtctggcgcctcagcctccctggccatcagtgggctccagtctgaggatgaggctgattattactgtgctgcatgggatgacagcctgaatgcttgggtgttcggcggagggaccaagctgaccgtcctaggtcagaccccg

SEQ ID NO: 558765 - DNA, 487 bp, Homo sapiens; identical to SEQ ID NO: 536206
  misc_feature: HIJSMM301D343Z.47.38.D05.1.454.light.4.raw

SEQ ID NO: 558766 - DNA, 495 bp, Homo sapiens; identical to SEQ ID NO: 537415
  misc_feature: HIJSMM301BYLY2.4.27.C05.1.454.light.4.raw

SEQ ID NO: 558767 - DNA, 500 bp, Homo sapiens
  misc_feature: HIJSMM301CR8F2.47.66.F11.1.454.light.4.raw
agctcacgtacacgaccggtgctcgatttagtcacgcgagaagggggaggaactgctcagttaggacccagagggaaccatggaagccccagctcagcttctcttcctcctgctactctggctcccagaaatcgccggagacattctattgacgcaggctccagtcaccctgtctttgtctccaggggaaagagccaccctctcctgcagggccagtcaaagcatcggcaacaatttggcctggtatcaacagaaacctggccaggctcccaggctcctcatctacgatgcatccaacagggccactggcgtcccaggcaggttcagaggcggtgggtctgggacagacttcactctcaccattgacggcctagagcctgaagattttgcagtttattactgtcagcagcgtaacaattggccgatcaccttcggccaagggacacgactggagattaaacgaactgtggctgcaccatctgtcttcatcttcccgccat

SEQ ID NO: 558768 - DNA, 499 bp, Homo sapiens; identical to SEQ ID NO: 543887
  misc_feature: HIJSMM301DPBID.10.65.F10.1.454.light.4.raw

SEQ ID NO: 558769 - DNA, 498 bp, Homo sapiens
  misc_feature: HIJSMM301DECXP.26.80.H03.1.454.light.4.raw
agactatactcacgaccggtgctcgatttagctgtgcgtcgaagggaaagggactgactaccacctgcaggtcagggccaaggttatggggtcccaggttcacctcctcagcttcctcctcctttggatctctgagccgacactcacgcagtctccagcattcatgtcagcgactctaggagacaaggtcaacttctcctccaaagccagccaagacattgatgatgatatgaactggcaccaacacaaaccaggagaagctgctatttccattactcaagaaactaatggtctcctacctggaatgccacctcgactcagtggcaacaaatatggaacagtttttaccctcacaactcatatcacagaatctgaggatgctgcattttacttcggtctacaacatgataatttccctccgtggacgttcggccaagggaccaaggagcaaatcaaacgaactgtggctgcaccatctgtcttcatccttcccgccat

SEQ ID NO: 558770 - DNA, 506 bp, Homo sapiens; identical to SEQ ID NO: 534969
  misc_feature: HIJSMM301ARZE7.18.37.D04.1.454.light.4.raw

SEQ ID NO: 558771 - DNA, 494 bp, Homo sapiens
  misc_feature: HIJSMM301CZZMW.21.27.C05.1.454.light.4.raw
  modified_base (196)..(196): a, c, t, g, unknown or other
tcgtcgctcgcacgaccggtgctcgatttagacgcgatcgaagggtttggggggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttagcctggtaccagcagaaatctggccaggctcccaggctcctcatttaccgtgcatccaccagggccactggtgtcccagacaggttcagtggcggtggatttgggacagagttttctctcaccatcagcgccctacagagtgaagatgttgcagtttatttctgccagcaatataattactggcctgcgtcgacgttcggccacgggaccaaggtggaaatcaaacgaactgtggctgcaccatctgtcttc

SEQ ID NO: 558772 - DNA, 485 bp, Homo sapiens
  misc_feature: HIJSMM301EFW15.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtggcccgctcattttcggcggagggaccaaggtgcagatacaaacgaactgtggctgca

SEQ ID NO: 558773 - DNA, 490 bp, Homo sapiens; identical to SEQ ID NO: 541567
  misc_feature: HIJSMM301DB0KY.22.65.F10.1.454.light.4.raw

SEQ ID NO: 558774 - DNA, 509 bp, Homo sapiens
  misc_feature: HIJSMM301EJGW8.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactgtggctgcaccatctgtcttcactcttcccgccact

SEQ ID NO: 558775 - DNA, 495 bp, Homo sapiens; identical to SEQ ID NO: 546146
  misc_feature: HIJSMM301EJP6Z.27.78.H01.1.454.light.4.raw

SEQ ID NO: 558776 - DNA, 490 bp, Homo sapiens
  misc_feature: HIJSMM301EZAT3.49.41.D08.1.454.light.4.raw
agtcgagagacacgaccggtgctcgatttagtcacgcgagaaagggaaagggcacagcatggacatgagggtccccgctcagctcctggggctcctgctactctggctccgaggtgccagatgtgacatccagatgacccagtctccatcctccctgtctgcatctgtaggagacagagtcaccatcatttgccgggcaagtcagagtattagcaactatttaaattggtatcaacataccccggggaaggcccctaggttactgatctatgctgcagccaatttgcaaagtggggtcccatcaaggttcagtggcagtggatctgggacagaattcactctcaccatcagcagtctgcaacctgaagattttggaaagtactattgtcaacagagttacggaaacttgctcattttcggcggagggaccaaggtggagatcaaacgaactgtggctgcaccatctgtcttcatcttcccgccatctgat

SEQ ID NO: 558777 - DNA, 460 bp, Homo sapiens; identical to SEQ ID NO: 536053
  misc_feature: HIJSMM301BZWBS.22.28.C06.1.454.light.4.raw

SEQ ID NO: 558778 - DNA, 512 bp, Homo sapiens; identical to SEQ ID NO: 548540
  misc_feature: HIJSMM301EJ8L9.15.76.G10.1.454.light.4.raw

SEQ ID NO: 558779 - DNA, 486 bp, Homo sapiens
  misc_feature: HIJSMM301AICSQ.5.45.E01.1.454.light.4.raw
atcagacacgcacgaccggtgctcgatttagtgagtcagtaagggaaagggggagtcagacccagtcaggacacagcatggacatgagggtccccgctcagctcctggggctcctgctgctctggttcccaggttccagatgcgacatccagatgacccagtctccttctttcgtgtctgcgtctgtaggagacagacttactatcgcttgtcgggcgagtcaggatattagtaccaggttagcctggtatcagcagaagcctgggagagcccctaaactcctgatctatgctgcatcaagtctgcaaagtggggtcccatcgaggttcagaggcagtggatctgggacagatttcactctcaccatcagcggcctgcagcctgaagattatgcaacttactattgtcaaagttctaatgctttcccgcgcacgtttggtccaggggaccgaaggtagagatcaaacgaactagtggctgcaccat

SEQ ID NO: 558780 - DNA, 494 bp, Homo sapiens; identical to SEQ ID NO: 557656
  misc_feature: HIJSMM301CZ0OH.22.5.A05.1.454.light.4.raw

SEQ ID NO: 558781 - DNA, 486 bp, Homo sapiens
  misc_feature: HIJSMM301DHFVR.9.19.B08.1.454.light.4.raw
  modified_base (459)..(459): a, c, t, g, unknown or other
tgatacgtctcacgaccggtgctcgatttagtgagtcagtaagggggaggctctgcttcagctgtgggcacaagaggcagtactcaggacaatctccagcatgccctggtctcctctcctcctcactctcctcgctcactgcacagggtcctgggcccagtctgtgctgacgcagccgccctcagtgtctggggccccagggcagagggtcaccatctcctgcactggcagcagttccaacatcggggcaggttatgatgtccactggtaccagcagtttccaggaacagcccccagggtcctcatctttggttacagtaatcggccctcaggggtccctgaccgattctctggctccaagtctgacacctcagcctccctggccatcactgggctccagactgaggatgaggctcattattactgccagtcttatgacaaacgtcagaacatttgggngttcggcggagggaccaagctgaccgt

SEQ ID NO: 558782 - DNA, 350 bp, Homo sapiens; identical to SEQ ID NO: 537421
  misc_feature: HIJSMM301CWQ7T.13.11.A11.1.454.light.4.raw

SEQ ID NO: 558783 - DNA, 485 bp, Homo sapiens; identical to SEQ ID NO: 536799
  misc_feature: HIJSMM301DGFAV.19.71.G05.1.454.light.4.raw

SEQ ID NO: 558784 - DNA, 486 bp, Homo sapiens; identical to SEQ ID NO: 535917
  misc_feature: HIJSMM301C0FIW.3.10.A10.1.454.light.4.raw

SEQ ID NO: 558785 - DNA, 454 bp, Homo sapiens; identical to SEQ ID NO: 535005
  misc_feature: HIJSMM301A7KRQ.19.86.H09.1.454.light.4.raw

SEQ ID NO: 558786 - DNA, 509 bp, Homo sapiens
  misc_feature: HIJSMM301AQ3EI.8.42.D09.1.454.light.4.raw
ctcgcgtgtccacgaccggtgctcgatttagacacatacgcagggaaagggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcggcggagggaccaagttgaccgtcctaggtcagcccaaggctgccccctcggtcactctgttcccacctcc

SEQ ID NO: 558787 - DNA, 479 bp, Homo sapiens
  misc_feature: HIJSMM301BST0L.11.17.B06.1.454.light.4.raw
cgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccgggcaagtcagatcattagcagctatttaaattggtatcagcagaaaccagggaaagcccctgaggtcctgatctatgctgcatccagtttgcagagtggggtcccatcaaggttcagtggcagtggatctgcgacagatttcactctcaccatcagcagtctgcaacctgaagattttgcaacttactactgtcaacagagttacagtaccccgtggacgttcggccaagggaccaaggtggaaatacaaacgaactagtggctgca

SEQ ID NO: 558788 - DNA, 506 bp, Homo sapiens
  misc_feature: HIJSMM301BYV0P.22.46.E02.1.454.light.4.raw
  modified_base (415)..(415): a, c, t, g, unknown or other
acatacgcgtcacgaccggtgctcgatttagactcatctacagggaaaggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtccgtcaccatctcctgcactgggaccagcagtgatgttggtgcttataactatgtctcctggtaccagcaccacccaggcaaagccccccaactcttaatttttggtgtcaataaccgcccctcaggggtccctgatcgcttctccggctccaagtctggcaacacggcctccctgaccatctctggactccaggctgacgatgagggtgacttttacngctgctcatatgcaggcaactataatatggtcttcggcggagggaccaaagtgaccgtcctaggtcagcccaaggctgccccctggtcact

SEQ ID NO: 558789 - DNA, 480 bp, Homo sapiens; identical to SEQ ID NO: 553480
  misc_feature: HIJSMM301CSTA3.21.25.C03.1.454.light.4.raw

SEQ ID NO: 558790 - DNA, 481 bp, Homo sapiens
  misc_feature: HIJSMM301EQ7NS.15.8.A08.1.454.light.4.raw
tctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtatcccagccaggttcagtggcagtgggtctggcacagagttcactctcaccatcagcagcccgcagtctgaagattttgcagtttattactgtcagcaatataacaagtggccattcactttcggcccagggaccaagtggatatcaaacgaactgtggctgcaccatctgtcttcatcttcccgccatctgagctacg

SEQ ID NO: 558791 - DNA, 503 bp, Homo sapiens
  misc_feature: HIJSMM301B1VW6.49.37.D04.1.454.light.4.raw
agtcgagagacacgaccggtgctcgatttagtagcatactgttgggtttgggggctggggtctcaggaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaactcatcatttatgaggccgatcagcggccctcaggggtctctgatcgcttctctggctccacgtctggcagcacggcctccctgacaatctctgggctccaggctggggacgaggctgattattattgctgttcatatgccggtgatagtggccaagggtgttcggcggagggaccaaggtgacgtcctaggtcagcccaaggctgccccc

SEQ ID NO: 558792 - DNA, 494 bp, Homo sapiens
  misc_feature: HIJSMM301BXPNR.10.79.H02.1.454.light.4.raw
catagtagtgcacgaccggtgctcgatttagtgtcacacgaagggaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggccaggggaccaagctggagatcaacgaactgtggctgcaccatctgtctt

SEQ ID NO: 558793 - DNA, 508 bp, Homo sapiens
  misc_feature: HIJSMM301CMTVZ.18.37.D04.1.454.light.4.raw
  modified_base (479)..(479): a, c, t, g, unknown or other
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacgccgctcacttcgtcggagggacgacggaggaggagtnaacgaactagtggcgtgcaccactctgtt

SEQ ID NO: 558794 - DNA, 481 bp, Homo sapiens
  misc_feature: HIJSMM301DT5KN.46.26.C04.1.454.light.4.raw
actagcagtacacgaccggtgctcgatttagtctagcgactttgggtttggggtgatcaggactcctcagttcaccttctcacaatgaggctccctgctcagctcctgggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatcatttttttggctaatcgggcctccgggtcctgacaggttcagtggcagtggatcaggcacagattttacactgaaaatcagcagagtggaggctgaggatgttgggctctattattgcatgcaagctctacaagtcccgctcactttcggcggagggaccaaggtggagatcaaacgaa

SEQ ID NO: 558795 - DNA, 478 bp, Homo sapiens; identical to SEQ ID NO: 535129
  misc_feature: HIJSMM301B6PGF.11.11.A11.1.454.light.4.raw

SEQ ID NO: 558796 - DNA, 486 bp, Homo sapiens; identical to SEQ ID NO: 535043
  misc_feature: HIJSMM301A5MNF.46.35.D02.1.454.light.4.raw

SEQ ID NO: 558797 - DNA, 503 bp, Homo sapiens
  misc_feature: HIJSMM301B30OL.5.86.H09.1.454.light.4.raw
atcagacacgcacgaccggtgctcgatttagtgctatagacttggggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggccaagctgaccgtcctaggtcagcccaaggctgccccctcggtca

SEQ ID NO: 558798 - DNA, 488 bp, Homo sapiens; identical to SEQ ID NO: 538017
  misc_feature: HIJSMM301BM738.4.59.F04.1.454.light.4.raw

SEQ ID NO: 558799 - DNA, 490 bp, Homo sapiens; identical to SEQ ID NO: 535526
  misc_feature: HIJSMM301DWX5O.26.78.H01.1.454.light.4.raw

SEQ ID NO: 558800 - DNA, 494 bp, Homo sapiens; identical to SEQ ID NO: 541183
  misc_feature: HIJSMM301A6IR1.19.71.G05.1.454.light.4.raw

SEQ ID NO: 558801 - DNA, 481 bp, Homo sapiens
  misc_feature: HIJSMM301BOJ4E.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgcgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagtattttactttcaccatcagcagcctgcagcctgaagatattgcaacatattactgtcaacagtatcataatctcccactttcggcctggaccaagtggatatcaacgaactgtggctgcaccatctgt

SEQ ID NO: 558802 - DNA, 510 bp, Homo sapiens; identical to SEQ ID NO: 535474
  misc_feature: HIJSMM301AJ8NG.17.33.C11.1.454.light.4.raw

SEQ ID NO: 558803 - DNA, 501 bp, Homo sapiens; identical to SEQ ID NO: 542364
  misc_feature: HIJSMM301AN77L.7.71.G05.1.454.light.4.raw

SEQ ID NO: 558804 - DNA, 493 bp, Homo sapiens; identical to SEQ ID NO: 543205
  misc_feature: HIJSMM301DAZN1.51.6.A06.1.454.light.4.raw

SEQ ID NO: 558805 - DNA, 491 bp, Homo sapiens; identical to SEQ ID NO: 543478
  misc_feature: HIJSMM301ARAYN.14.55.E11.1.454.light.4.raw

SEQ ID NO: 558806 - DNA, 478 bp, Homo sapiens; identical to SEQ ID NO: 535129
  misc_feature: HIJSMM301C29ZU.11.11.A11.1.454.light.4.raw

SEQ ID NO: 558807 - DNA, 503 bp, Homo sapiens; identical to SEQ ID NO: 538884
  misc_feature: HIJSMM301D5XHD.27.78.H01.1.454.light.4.raw

SEQ ID NO: 558808 - DNA, 495 bp, Homo sapiens
  misc_feature: HIJSMM301BKTM0.51.39.D06.1.454.light.4.raw
cgatcgtatacacgaccggtgctcgatttagtgacatctcgcagttctttgggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccaacagaagccaggccaggcccctgtgttgttgatatataaagacagtgagaggccttcagggatccctgagcgattctctggctccacctcagggacactggtcacattgaccatcagtggagtccaggcagaagacgaggctgactattctgtcaatcttcagacgtcagtggtacttatgtcttcggaactgggaccaaggtcaccgtcctaggtcagcccaaggccaacccactgtcact

SEQ ID NO: 558809 - DNA, 489 bp, Homo sapiens; identical to SEQ ID NO: 542780
  misc_feature: HIJSMM301DTQTY.16.53.E09.1.454.light.4.raw

SEQ ID NO: 558810 - DNA, 481 bp, Homo sapiens; identical to SEQ ID NO: 535993
  misc_feature: HIJSMM301AFITM.21.25.C03.1.454.light.4.raw

SEQ ID NO: 558811 - DNA, 485 bp, Homo sapiens; identical to SEQ ID NO: 536075
  misc_feature: HIJSMM301D714J.17.21.B10.1.454.light.4.raw

SEQ ID NO: 558812 - DNA, 497 bp, Homo sapiens; identical to SEQ ID NO: 535286
  misc_feature: HIJSMM301BFH67.18.59.F04.1.454.light.4.raw

SEQ ID NO: 558813 - DNA, 501 bp, Homo sapiens
  misc_feature: HIJSMM301CD01X.11.59.F04.1.454.light.4.raw
cgagagataccacgaccggtgctcgatttagtacacacacttagggattggggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctactcttttctcttcggaactgggaccacggtcaccgtcctaggtcagcccaaggccaaccccactgtcactctgttccccaccctcctcgtatctctcg

SEQ ID NO: 558814 - DNA, 501 bp, Homo sapiens
  misc_feature: HIJSMM301B8E2S.19.67.G01.1.454.light.4.raw
tactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttctccacctccaagaacaaaaacttcttagcctggtaccaacagagaccaggacagcctcctaagttgctcatttactgggcttctacgcgcgaattcggggtccctgaccgattccggggcagcgggtctgggacagatttcactctcaccatcagcagcctgcaggctgaagatgtggcagtttattactgtcagcaatatttttctatcctccgtggacgttcggccaagggccaggtggaaatcagacgaactgtggctgcaccat

SEQ ID NO: 558815 - DNA, 493 bp, Homo sapiens; identical to SEQ ID NO: 538304
  misc_feature: HIJSMM301B9RVA.26.72.G06.1.454.light.4.raw

SEQ ID NO: 558816 - DNA, 496 bp, Homo sapiens
  misc_feature: HIJSMM301DFE48.22.5.A05.1.454.light.4.raw
acatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaagagccaccctctcctgcagggccagtcagagtgttaactactacttagcctggtaccaacagaaacctgaccaggctcccaggctcctcatctatgatgcatcttacagggccactggcatcccagccaggttcagtggcagtgggtctgggacagacttcactctcaccatcagcagcctagagcctgaagattttgcagtttattactgtcagcagcgtagcaactccctcacgttcggcggagggaccaaggtggagatcaaacgaactgtggctgcaccatctgtcttcacttcccgccat

SEQ ID NO: 558817 - DNA, 499 bp, Homo sapiens; identical to SEQ ID NO: 550763
  misc_feature: HIJSMM301ARZH7.19.78.H01.1.454.light.4.raw

SEQ ID NO: 558818 - DNA, 517 bp, Homo sapiens
  misc_feature: HIJSMM301ET5Y9.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgtcggtccaggaccgaacggtaggaagtacgaaacgaaactacgtggctgcaccactctgtcttctactcttcccgtcccact

SEQ ID NO: 558819 - DNA, 501 bp, Homo sapiens
  misc_feature: HIJSMM301C1U6U.18.78.H01.1.454.light.4.raw
tacgagtatgcacgaccggtgctcgatttagtgtgagtagtttgggtttgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggcccaacccact

SEQ ID NO: 558820 - DNA, 490 bp, Homo sapiens; identical to SEQ ID NO: 536855
  misc_feature: HIJSMM301CDOQE.16.68.G02.1.454.light.4.raw

SEQ ID NO: 558821 - DNA, 512 bp, Homo sapiens
  misc_feature: HIJSMM301DCOK8.7.34.D01.1.454.light.4.raw
cgtgtctctacacgaccggtgctcgatttagatcgtctgtgttggggtttggggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggactccagactgaggacgaggctgattattactgctgctcatatacaggggacagcattatttgggtgttcggcggagggaccaagctgaccgtcctgcgtcagcccaaggctgccccctcggtcact

SEQ ID NO: 558822 - DNA, 515 bp, Homo sapiens
  misc_feature: HIJSMM301CCYWQ.41.9.A09.1.454.light.4.raw
tctatactatcacgaccggtgctcgatttagcgagacgcgcaggggagcttcagctgtgggtagagaagacaggactcaggacaatctccagcatggccagcttccctctcctcctcaccctcctcactcactgtgcagggtcctgggcccagtctgtcctgactcagccaccctcagcgtctgggacccccgggcagacggtgaccatctcctgttctggaagcagttccaacatcggaagtaataatgtgaattggtaccggcaactcccaggaacggcccccaaactcctcatacatagtaatgatcatcggccccctggggtccctgaccgaatctctggctccaggtctggcgcctcagcctccctggtcattagtgggctccagtcttgacgatgaggctgactattactgttcagcgtgggatgccagcccgaatcattgggtgttcggcggagggaccaaactgaccgtcctaggtcagcccaaggctgccccctcggtcactctcg

SEQ ID NO: 558823 - DNA, 499 bp, Homo sapiens
  misc_feature: HIJSMM301COO3V.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggccgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagaccgttcggccaaagggaccaaggtgtaaaatcaaacgaactgtggctgcacc

SEQ ID NO: 558824 - DNA, 478 bp, Homo sapiens; identical to SEQ ID NO: 535129
  misc_feature: HIJSMM301AIG5Y.11.11.A11.1.454.light.4.raw

SEQ ID NO: 558825 - DNA, 488 bp, Homo sapiens
  misc_feature: HIJSMM301A9D47.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcggtcggagggaccgaaggtggagatcaaacgaa

SEQ ID NO: 558826 - DNA, 488 bp, Homo sapiens; identical to SEQ ID NO: 535568
  misc_feature: HIJSMM301C4YF0.21.4.A04.1.454.light.4.raw

SEQ ID NO: 558827 - DNA, 506 bp, Homo sapiens
  misc_feature: HIJSMM301DRXXH.48.16.B05.1.454.light.4.raw
agtatacatacacgaccggtgctcgatttagagctcacgtaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctagacaatcgattaccatctcctgcactggaaccagcagtgatattgggagtcataaccttgtctcctggtatcaacaatatccaggcagagccccccaactcataatttatgcggcctctcagcggcccccaggggtttccagtcgcttctctgcctccaagtctggcaacacggcctccttgacaatctctggcctccagcctgaggacgaggctgactattactgctgctcatatacaactatgaatgcttttttgttcggtcggagggaccaaactgaccgtcctcggtcggcccaaggctgccccctcggtcactctcg

SEQ ID NO: 558828 - DNA, 484 bp, Homo sapiens; identical to SEQ ID NO: 540581
  misc_feature: HIJSMM301CMVPJ.3.88.H11.1.454.light.4.raw

SEQ ID NO: 558829 - DNA, 487 bp, Homo sapiens
  misc_feature: HIJSMM301EIHZ4.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggaggaccaaggcggagatcagacgaactgtggctgcaccatctgtcttca

SEQ ID NO: 558830 - DNA, 508 bp, Homo sapiens
  misc_feature: HIJSMM301B864K.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggctttcggcggagggaccaagctgaccgtcctggtcagcccgaaggctcgccccctcggtcctacc

SEQ ID NO: 558831 - DNA, 493 bp, Homo sapiens; identical to SEQ ID NO: 535566
  misc_feature: HIJSMM301C43RA.16.6.A06.1.454.light.4.raw

SEQ ID NO: 558832 - DNA, 511 bp, Homo sapiens
  misc_feature: HIJSMM301DROGG.16.83.H06.1.454.light.4.raw
tgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtggccccaggacagacggccagcataacctgtgggggaaacggccttggacgtaaaagtgtgcactggtaccagcagaagccaggccaggcccctgtgctggtcgtctatgatgatagcgaccggccctcagggatccctgagcgattctctggctccaactctgggaacgcggccaccctgaccatcagcagggtcgaagccggggatgaggccgactattactgtcaggtgtgggatagtagtagtgatcattatgtcttcggatctgggaccagggtcaccgtcctaggtcagcccaaggccaacccactgtcactctgttcccacct

SEQ ID NO: 558833 - DNA, 517 bp, Homo sapiens
  misc_feature: HIJSMM301BMR1X.5.27.C05.1.454.light.4.raw
atcagacacgcacgaccggtgctcgatttagacgcgatcgaagggtttgggggtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtctaggtcagcccaaggccaacccactgtcactctgttcccgccctcctccgt

SEQ ID NO: 558834 - DNA, 490 bp, Homo sapiens; identical to SEQ ID NO: 548406
  misc_feature: HIJSMM301A0C8M.52.27.C05.1.454.light.4.raw

SEQ ID NO: 558835 - DNA, 504 bp, Homo sapiens; identical to SEQ ID NO: 535561
  misc_feature: HIJSMM301ADJKP.4.57.F02.1.454.light.4.raw

SEQ ID NO: 558836 - DNA, 497 bp, Homo sapiens
  misc_feature: HIJSMM301AOWLC.40.57.F02.1.454.light.4.raw
tctagcgactcacgaccggtgctcgatttagctcgatatagttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttattttgctgcttcttatgcaggcagttcgctctcgaagtgttcggcggaggaccgagctgaccgtcctacgtcagcccaaggctccg

SEQ ID NO: 558837 - DNA, 495 bp, Homo sapiens; identical to SEQ ID NO: 539809
  misc_feature: HIJSMM301D55VW.3.33.C11.1.454.light.4.raw

SEQ ID NO: 558838 - DNA, 486 bp, Homo sapiens; identical to SEQ ID NO: 536261
  misc_feature: HIJSMM301DI1X4.26.55.E11.1.454.light.4.raw

SEQ ID NO: 558839 - DNA, 469 bp, Homo sapiens
  misc_feature: HIJSMM301DXA3G.51.16.B05.1.454.light.4.raw
cgatcgtatacacgaccggtgctcgattttagagctcacgtaagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatctcttgccaggcgagtcaggacattataagatatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaggatcttgcaacatattactgtcaacagtatgataatgtcccgtacacttttggccaggggaccaagctggagatcagacgaactgtgg

SEQ ID NO: 558840 - DNA, 488 bp, Homo sapiens; identical to SEQ ID NO: 538291
  misc_feature: HIJSMM301ECNRD.19.71.G05.1.454.light.4.raw

SEQ ID NO: 558841 - DNA, 493 bp, Homo sapiens
  misc_feature: HIJSMM301DAUEM.40.36.D03.1.454.light.4.raw
tctagcgactcacgaccggtgctcgatttagctgcgtcacgatctctcttgggggagctacaacaggcaggcaggggcagcaagatggtgttgcagacccaggtcttcatttttctgttgctctggatctctggtgcctacggggacatcgtgatgacccagtctccagactccctggctgtgtctctgggcgagagggccaccatcaactgcaagtccagccagagtcttttatacaactccaacaagcagcactacttagcttggtaccagcagaaaccaggacagcctcctaaactgctcatttactgggcctctacccgggaatccggggtccctgaccgattcagtggcagcgggtctgggacagatttcactctgaccatcagcagcctgcaggctgaagatgtggcagtttattactgtcaacaatattatattattccgaggacgttcggccaagggaccaaggtggaaatcaaacgaactgtgg

SEQ ID NO: 558842 - DNA, 484 bp, Homo sapiens; identical to SEQ ID NO: 540581
  misc_feature: HIJSMM301D4PVQ.3.88.H11.1.454.light.4.raw

SEQ ID NO: 558843 - DNA, 495 bp, Homo sapiens
  misc_feature: HIJSMM301C32ZK.40.28.C06.1.454.light.4.raw
tctagcgactcacgaccggtgctcgatttagagctcacgtattgggtttgggggctggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttatttttgctgctcttatgcaggcagtttcgctctcgaagtgttcggcggagggaccgagctgaccgtcctacgtcagcccaa

SEQ ID NO: 558844 - DNA, 496 bp, Homo sapiens; identical to SEQ ID NO: 535109
  misc_feature: HIJSMM301BPTO8.16.78.H01.1.454.light.4.raw

SEQ ID NO: 558845 - DNA, 501 bp, Homo sapiens
  misc_feature: HIJSMM301BASGF.13.55.E11.1.454.light.4.raw
tcacgtactacacgaccggtgctcgatttagcactcgcacgttgggtttgggggagtcagtctcagtcaggacacagcatggacatgagggtccccgctcagctcctggggctcctgctactctggctccgaggtttgccaaatgtgacatccagatgacccagtctccatcctccctgtctgcatctgtaggagacagagtcaccatcacttgccgggcaagtcagagcattaccaactatttgaattggtatcaacaaaaaccagggagagcccctcacctccttatctatggtgcatccaccttacaaagtggggtcccatcaaggttcagtggcactggatctgggacagatttcactctcaccatcagcagtctgcaacctgaagattttgcaacttattactgtcaacagagtttcagtacgcggacgtcgccaggacgaacggtggaagtcaaacgaactagtggctgcaccactctgtcttctatcttccccg

SEQ ID NO: 558846 - DNA, 487 bp, Homo sapiens; identical to SEQ ID NO: 537220
  misc_feature: HIJSMM301EAE0L.16.53.E09.1.454.light.4.raw

SEQ ID NO: 558847 - DNA, 509 bp, Homo sapiens; identical to SEQ ID NO: 543741
  misc_feature: HIJSMM301D8LZD.17.33.C11.1.454.light.4.raw

SEQ ID NO: 558848 - DNA, 501 bp, Homo sapiens; identical to SEQ ID NO: 536867
  misc_feature: HIJSMM301EQ0UC.5.86.H09.1.454.light.4.raw

SEQ ID NO: 558849 - DNA, 507 bp, Homo sapiens
  misc_feature: HIJSMM301C3CI3.40.41.D08.1.454.light.4.raw
tctagcgactcacgaccggtgctcgatttagtcacgcgagaaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactccccatgtggtattcggcggagggaccaagctgaccgtcctaggtcagcccaaggctgtccccccg

SEQ ID NO: 558850 - DNA, 488 bp, Homo sapiens; identical to SEQ ID NO: 535081
  misc_feature: HIJSMM301C2W2Y.26.23.C01.1.454.light.4.raw

SEQ ID NO: 558851 - DNA, 503 bp, Homo sapiens; identical to SEQ ID NO: 541454
  misc_feature: HIJSMM301CPVZ5.9.12.B01.1.454.light.4.raw

SEQ ID NO: 558852 - DNA, 503 bp, Homo sapiens; identical to SEQ ID NO: 538884
  misc_feature: HIJSMM301DNTHA.27.78.H01.1.454.light.4.raw

SEQ ID NO: 558853 - DNA, 505 bp, Homo sapiens; identical to SEQ ID NO: 535503
  misc_feature: HIJSMM301CU45Y.8.28.C06.1.454.light.4.raw

SEQ ID NO: 558854 - DNA, 512 bp, Homo sapiens
  misc_feature: HIJSMM301BFQBJ.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaactagttttcctcgggcgttcggccgaacgggaccgaaggtaggaaagtacaaacgaactagtggctgcaccatctgtcttctatcttccccg

SEQ ID NO: 558855 - DNA, 484 bp, Homo sapiens; identical to SEQ ID NO: 535400
  misc_feature: HIJSMM301DDCMX.46.26.C04.1.454.light.4.raw

SEQ ID NO: 558856 - DNA, 520 bp, Homo sapiens
  misc_feature: HIJSMM301DRIYR.12.71.G05.1.454.light.4.raw
atacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaaagtgaccgtcctaagtcagcccaaggctgccccctcggtcactctgttcccgccct

SEQ ID NO: 558857 - DNA, 481 bp, Homo sapiens
  misc_feature: HIJSMM301CN3ZP.48.2.A02.1.454.light.4.raw
agtatacatacacgaccggtgctcgatttagactcatctacaggggggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagcggcagtggatctggcacagagttcactctcaccatcagcaccctgcagcctgaagattttgcgacttatttctgtctacaagattctaattaccctcggacgttcggccaggggaccgaaacgtaggagtgtcaaccgaactgtggctgcacca

SEQ ID NO: 558858 - DNA, 494 bp, Homo sapiens
  misc_feature: HIJSMM301BU630.15.67.G01.1.454.light.4.raw
tctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagatttcactctcaccatcagcagcctgcagcctgaagatttcgcaacttattactgtctacaagattacaattaccctcggacgttcggtccagggaccgaacggtggaaagtacaaacgaactagtggtcgtgcacca

SEQ ID NO: 558859 - DNA, 487 bp, Homo sapiens
  misc_feature: HIJSMM301DITWY.52.87.H10.1.454.light.4.raw
cgcagtacgacacgaccggtgctcgatttagcagtactgcgttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacgtatccctgatcgcttctcaggctccggctctgggactgagcgctacctcaccatctccagcctccagtctgaggacgagggtgactattactgtcagacgtgggacactggcagtttgggtgttcggcggagggaccaaggttcgaccgtctaggtcagcccaaggcctcg

SEQ ID NO: 558860 - DNA, 486 bp, Homo sapiens
  misc_feature: HIJSMM301EOLDF.49.81.H04.1.454.light.4.raw
agtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgtatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatctaccactcactttcggcggagggaccacggtggagatcaaacgaactgtggctgcaccatctgtcttcatt

SEQ ID NO: 558861 - DNA, 514 bp, Homo sapiens
  misc_feature: HIJSMM301BBCPU.40.12.B01.1.454.light.4.raw
tctagcgactcacgaccggtgctcgatttagtagtgtagattccgcgggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaactacacccaggcaaagcccccaaactcatgatttctgacgtcagtaagcggccctcaggggtccctgatcgcttctctggctccaagtctggcaacacggcctccctgaccgtctctgggctccaggctgaagatgaggctgattattactgctactcgtatgcaggcggcaacaattgggtcttcggcggagggaccaagctgaccgtcctaggtcagcccaaggctgccccctcggtcactctgttccca

SEQ ID NO: 558862 - DNA, 470 bp, Homo sapiens
  misc_feature: HIJSMM301DBJ6J.5.70.G04.1.454.light.4.raw
atcagacacgcacgaccggtgctcgatttagtgtagtgtgaagggaaagggggcaggagtcagacccagtcaggacacagcatggacatgagggtccccgctcagctcctggggctcctgctgctctggttcccaggttccagttgcgacatccagatgacccagtctccatcttccgtgtctgcatctgtgggagacagagtcaccatcacttgtcgggcgagtcagggtgttagcagctggttagcctggtatcagcagaaaccagggaaagcccctaagctcctgatctatgctgcatccatcttgcagagtggggtcccatcaaggttcatcggcagtggatctgggacagatttcactctcaccatcagcagcctgcagcctgaagattttgcaacttactttgtcaacaggctcagagtttcccgctcactttcggcggagggaccaaggtgagatcaaacgaa

SEQ ID NO: 558863 - DNA, 488 bp, Homo sapiens
  misc_feature: HIJSMM301B5872.47.70.G04.1.454.light.4.raw
agctcacgtacacgaccggtgctcgatttagtgtagtgtgaagggaaaggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtaccccgtacaccttttggccaggggaccaaactggacatcaaacgaactgtggctgcaccatctgtt

SEQ ID NO: 558864 - DNA, 422 bp, Homo sapiens; identical to SEQ ID NO: 447881
  misc_feature: HIJSMM301BQPA7.9.34.D01.1.454.light.4.raw

SEQ ID NO: 558865 - DNA, 493 bp, Homo sapiens; identical to SEQ ID NO: 535745
  misc_feature: HIJSMM301AKXRC.47.78.H01.1.454.light.4.raw

SEQ ID NO: 558866 - DNA, 515 bp, Homo sapiens
  misc_feature: HIJSMM301BC6M9.22.36.D03.1.454.light.4.raw
acatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaacccccccaactcatcatttatggtgtcactcgtcggccctcaggagtctctcatcgcttctcaggctccaagtctggcaacacggcctccctaaccatctctgggctccagtttgaggacgagtctacttattactgcagttcctttaaattaggcgccactctcgtggttttcggcggaggcaccgaagtgaccgtcctcggtcagcccaaggctgccccctcggtcactctcg

SEQ ID NO: 558867 - DNA, 482 bp, Homo sapiens; identical to SEQ ID NO: 535352
  misc_feature: HIJSMM301EB74Z.16.81.H04.1.454.light.4.raw

SEQ ID NO: 558868 - DNA, 509 bp, Homo sapiens
  misc_feature: HIJSMM301D4SJL.17.2.A02.1.454.light.4.raw
  modified_base (506)..(506): a, c, t, g, unknown or other
cgtagactagcacgaccggtgctcgatttagactcatctacagggggggtagagaagacaggactcaggacaatctccagcatggccagcttccctctcctcctcaccctcctcactcactgtgcagggtcctgggcccagtctgtactgactcagccaccctcagcgtctgggacccccggacagagggtcaccatctcttgttctggaagcagctccaacatcgggactaatactgtaacctggttccagcacgtcccaggaacggccccaaactcgtcatgtataattatagtcagcggccctcaggggtccctgaccgattcgctggctccaactctggcacctcagcctccctggccatcagtgggctccagtctgaggatgaggctgattattactgtgcagcatgggatgccagcctgagtagtcccgtcttcggaactgggaccaaggtcaccgtcctacgtcagcccaaggccaaccccactgtcactctgttcccncct

SEQ ID NO: 558869 - DNA, 491 bp, Homo sapiens; identical to SEQ ID NO: 535294
  misc_feature: HIJSMM301BZ97M.16.68.G02.1.454.light.4.raw

SEQ ID NO: 558870 - DNA, 489 bp, Homo sapiens
  misc_feature: HIJSMM301A0EJO.19.71.G05.1.454.light.4.raw
tactctcgtgcacgaccggtgctcgatttagtgtcgtcgcaagagagaggggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagttttattattgtcaacaatattattatacttcgtggacgttcggccaagggaccaaggtggatatcagacgaa

SEQ ID NO: 558871 - DNA, 487 bp, Homo sapiens; identical to SEQ ID NO: 537208
  misc_feature: HIJSMM301A2JR9.3.55.E11.1.454.light.4.raw

SEQ ID NO: 558872 - DNA, 486 bp, Homo sapiens
  misc_feature: HIJSMM301AQ92B.3.10.A10.1.454.light.4.raw
agacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaagccaggccaggcccctgtggtggtgatatataaagacaggtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcaccgtcctaggtcagcccaaggcccaa

SEQ ID NO: 558873 - DNA, 485 bp, Homo sapiens; identical to SEQ ID NO: 536040
  misc_feature: HIJSMM301DWMGW.15.1.A01.1.454.light.4.raw

SEQ ID NO: 558874 - DNA, 485 bp, Homo sapiens
  misc_feature: HIJSMM301A6PM7.7.75.G09.1.454.light.4.raw
  modified_base (455)..(455): a, c, t, g, unknown or other
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacaggctgcccccaacttcggccaggggacacgactgganattaaacgaactgtggctgcaccatctgtt

SEQ ID NO: 558875 - DNA, 504 bp, Homo sapiens; identical to SEQ ID NO: 536385
  misc_feature: HIJSMM301DX39Z.27.78.H01.1.454.light.4.raw

SEQ ID NO: 558876 - DNA, 478 bp, Homo sapiens; identical to SEQ ID NO: 535129
  misc_feature: HIJSMM301CY2RM.11.11.A11.1.454.light.4.raw

SEQ ID NO: 558877 - DNA, 487 bp, Homo sapiens
  misc_feature: HIJSMM301C445W.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcgaggaccaaggcggagatcagacgaactgtggctgcaccatctgtcttcta

SEQ ID NO: 558878 - DNA, 483 bp, Homo sapiens
  misc_feature: HIJSMM301A534I.47.70.G04.1.454.light.4.raw
agctcacgtacacgaccggtgctcgatttagtgtagtgtgaagggaaaggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtaccccgtacacttttggccagggaccaaactggacatcaaacgaactgtggctgcaccatct

SEQ ID NO: 558879 - DNA, 491 bp, Homo sapiens
  misc_feature: HIJSMM301DCHS3.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaagaactgtggctgcaccatctgtcttcatcttcccgccat

SEQ ID NO: 558880 - DNA, 494 bp, Homo sapiens; identical to SEQ ID NO: 534994
  misc_feature: HIJSMM301BGGEV.27.78.H01.1.454.light.4.raw

SEQ ID NO: 558881 - DNA, 520 bp, Homo sapiens
  misc_feature: HIJSMM301BKSQH.27.23.C01.1.454.light.4.raw
  modified_base (516)..(516): a, c, t, g, unknown or other
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagccaaggctgccccctcggtcactctgttcccnccct

SEQ ID NO: 558882 - DNA, 494 bp, Homo sapiens
  misc_feature: HIJSMM301DG38Z.12.87.H10.1.454.light.4.raw
  modified_base (384)..(384): a, c, t, g, unknown or other
atacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcattgggggaaaagtttgctttctggtatcagcagaagccaggccagtcccctgtcttgatcatctataaggatagcaggcggccctcagggattcctgagcgattctccggctccaactccggcaacacagccactctgaccatcagcgggacccaggcnctcgatgaggctgactattactgccaggcgtgggacagctccacttcccgttatgtcttcggaggtggaccatggtcaccgtccctaggtcagcccaacgaccaacccca

SEQ ID NO: 558883 - DNA, 521 bp, Homo sapiens
  misc_feature: HIJSMM301EGF2L.41.19.B08.1.454.light.4.raw
  modified_base (514)..(514): a, c, t, g, unknown or other
tctatactatcacgaccggtgctcgatttagtgagtcagtaagggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaaccccactgtcactctcgttcccnccctcct

SEQ ID NO: 558884 - DNA, 506 bp, Homo sapiens
  misc_feature: HIJSMM301BQBUQ.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcgtcacggacaacggtaggaatacaagacgaactagtggcgtgcaccactctgtcttctactcttccgt

SEQ ID NO: 558885 - DNA, 510 bp, Homo sapiens
  misc_feature: HIJSMM301EM5SM.5.24.C02.1.454.light.4.raw
atcagacacgcacgaccggtgctcgatttagtacagatcgttagggaaagggggggtcgtcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaacctcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccactgtgatcttcggcggggggaccgaagctgaccgtcctaggtcagcccaaggctgccccccg

SEQ ID NO: 558886 - DNA, 416 bp, Homo sapiens; identical to SEQ ID NO: 536892
  misc_feature: HIJSMM301EPOAR.16.46.E02.1.454.light.4.raw

SEQ ID NO: 558887 - DNA, 499 bp, Homo sapiens
  misc_feature: HIJSMM301ESPO4.14.35.D02.1.454.light.4.raw
cgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtaccaacagaaaccaggacagtctcctaagttgctcattttctgggcatctacccgggaatccggggtccctgagcgattcagtggcagcgggtctgggacagatttcactttcaccatcagcagcctgcaggctgaagatgtggcagtttattactgtcagcaatattatagtactccctacacttttggccagggaccaagctggagatcaaacgaactgtggctgcacca

SEQ ID NO: 558888 - DNA, 502 bp, Homo sapiens; identical to SEQ ID NO: 537816
  misc_feature: HIJSMM301D9ULL.19.78.H01.1.454.light.4.raw

SEQ ID NO: 558889 - DNA, 494 bp, Homo sapiens
  misc_feature: HIJSMM301A2UOH.47.78.H01.1.454.light.4.raw
agctcacgtacacgaccggtgctcgatttagtgtgagtagtttgggtttggggtgatcaggactcctcagttcaccttctcacaatgaggctccctgctcagctcctggggctgctaatgctctgggtcccagatccagtggggatgttgtgatgactcagtctccactctccctgtccgtcacccttgcacagccggcctccatctcctgttggtctggtcaaggcctcgaatacagtgatggaaacacctgcttgaattgctttcaccagaggccaggccccatctccaaggcgcctaatttataagctttctaaccgggactctggggtcccagacagattcagcggcagtggcactgatgtcacactgacaatcagcagggtggaggctgaggatgttggggtttgttcctccatgcaaggtacacactggccttttggccaggggaccaacctggagatcaaatgaactgtggctgcaccatctgtctt

SEQ ID NO: 558890 - DNA, 502 bp, Homo sapiens
  misc_feature: HIJSMM301DY3EQ.4.71.G05.1.454.light.4.raw
  modified_base (236)..(236): a, c, t, g, unknown or other
agcactgtagcacgaccggtgctcgatttagtgtcgtcgcaagagagagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatntgcttattggtaccagcagaagtcaggccaggccccaaaattggtcatctatgaagacgacaaacgaccctccgggatccctgagagattctctggctccagctcagggactatggccaccttgactatcagtgggcccaagtggaggatgaagctgactactactgttactcaatagagaacagtgataatttctgggtgttcggcggagggaccaaactgaccgtcctaggtcagcccaaggctgccccctcggtcactctgtt

SEQ ID NO: 558891 - DNA, 475 bp, Homo sapiens
  misc_feature: HIJSMM301DKGJY.49.28.C06.1.454.light.4.raw
agtcgagagacacgaccggtgctcgatttagagctcacgtattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctcccgctcactttcggcgggggaccgaagtggaggatcaagcgaactgtggctgca

SEQ ID NO: 558892 - DNA, 510 bp, Homo sapiens
  misc_feature: HIJSMM301CSTY1.48.28.C06.1.454.light.4.raw
agtatacatacacgaccggtgctcgatttagagctcacgtattgggtttgggggtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctgttcccacct

SEQ ID NO: 558893 - DNA, 510 bp, Homo sapiens; identical to SEQ ID NO: 550828
  misc_feature: HIJSMM301DOG7V.10.88.H11.1.454.light.4.raw

SEQ ID NO: 558894 - DNA, 517 bp, Homo sapiens
  misc_feature: HIJSMM301DQZU0.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggccgacgggaccgaacggtaggaaggtacgaaacgaactagtggctgcaccatcctgtcttctatcttcccgtcccact

SEQ ID NO: 558895 - DNA, 505 bp, Homo sapiens
  misc_feature: HIJSMM301EVVOS.21.22.B11.1.454.light.4.raw
  modified_base (462)..(462): a, c, t, g, unknown or other
tcgtcgctcgcacgaccggtgctcgatttagacgacagctcgaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtnttcggcggagggaccaaactggaccgtcctaggtcagccccaa

SEQ ID NO: 558896 - DNA, 510 bp, Homo sapiens; identical to SEQ ID NO: 535855
  misc_feature: HIJSMM301AF198.17.33.C11.1.454.light.4.raw

SEQ ID NO: 558897 - DNA, 509 bp, Homo sapiens; identical to SEQ ID NO: 539359
  misc_feature: HIJSMM301BF7HP.47.85.H08.1.454.light.4.raw

SEQ ID NO: 558898 - DNA, 502 bp, Homo sapiens; identical to SEQ ID NO: 557696
  misc_feature: HIJSMM301AHTBL.22.15.B04.1.454.light.4.raw

SEQ ID NO: 558899 - DNA, 512 bp, Homo sapiens; identical to SEQ ID NO: 542831
  misc_feature: HIJSMM301EON7G.43.19.B08.1.454.light.4.raw

SEQ ID NO: 558900 - DNA, 496 bp, Homo sapiens
  misc_feature: HIJSMM301AO0J0.15.67.G01.1.454.light.4.raw
tctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagatttcactctcaccatcagcagcctgcagcctgaagatttcgcaacttattactgtctacaagatttacaattaccctcggacgttcggtccgacgggaccgaaggtggaaagtacaaacgaactagtggcgtgcgacca

SEQ ID NO: 558901 - DNA, 503 bp, Homo sapiens; identical to SEQ ID NO: 537216
  misc_feature: HIJSMM301BMSVM.3.70.G04.1.454.light.4.raw

SEQ ID NO: 558902 - DNA, 493 bp, Homo sapiens; identical to SEQ ID NO: 535745
  misc_feature: HIJSMM301A6FEO.47.78.H01.1.454.light.4.raw

SEQ ID NO: 558903 - DNA, 482 bp, Homo sapiens; identical to SEQ ID NO: 541033
  misc_feature: HIJSMM301EL2ZU.4.27.C05.1.454.light.4.raw

SEQ ID NO: 558904 - DNA, 503 bp, Homo sapiens; identical to SEQ ID NO: 538884
  misc_feature: HIJSMM301EH2BH.27.78.H01.1.454.light.4.raw

SEQ ID NO: 558905 - DNA, 510 bp, Homo sapiens
  misc_feature: HIJSMM301BAEMU.43.23.C01.1.454.light.4.raw
tgtgagtagtcacgaccggtgctcgatttagtacacgtgattagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaagcccccaaactcttgatttatgatgtcacttatcggccctcaggggtttcttatcgcttctctggctccaagtctggcaacacggcctccctgaccatctctgggctccaggctgaggacgaggctgattattactgcaactcacttacaacgaccgacacttgcgtattcggcggcgggaccaagctgaccgtcctaggtcagcccaaggctgcccctcggtcact

SEQ ID NO: 558906 - DNA, 494 bp, Homo sapiens
  misc_feature: HIJSMM301BVITE.49.66.F11.1.454.light.4.raw
agtcgagagacacgaccggtgctcgatttagtcacgcgagaaaggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccagccaggttcagtggcagtgggtttgggacagacttcacgctcaccatcagcagcctagagcctgaagattttgcagtttattactgtcaacagcgtaccacaggattcactttcggccctgggaccagagtggatatcaaacgaaactgtggctgcaccatctgtcttcatcttcccg

SEQ ID NO: 558907 - DNA, 490 bp, Homo sapiens
  misc_feature: HIJSMM301DVL1F.52.68.G02.1.454.light.4.raw
cgcagtacgacacgaccggtgctcgatttagtcgatagtgaagggaaagggggaagagctgctcagttaggacccagagggaaccatggaaaccccagcgcagcttctcttcctcctgctactctggctcccagatatcaccggggaaattgtgttgacgcagtctccaggcaccctgtctttgtctccaggggaaagagtcaccctctcctgcagggccagtcagagtgttctcgccagctacttagcctggtaccagcagaaacctggccaggctcccaggctcctcatctatgcttcatccagcagggccgctggcatcccagacaggttcagtggcagtgggtctgggacagacttcactctgaccatccacagactggagcctgaagattttgcggtgtattattgtcagcactatgatacctcactcatgtactacttttggccaggggaccaagctggagatcaaacgaactgtggctgcacc

SEQ ID NO: 558908 - DNA, 489 bp, Homo sapiens; identical to SEQ ID NO: 536013
  misc_feature: HIJSMM301D5PHS.26.23.C01.1.454.light.4.raw

SEQ ID NO: 558909 - DNA, 494 bp, Homo sapiens; identical to SEQ ID NO: 539894
  misc_feature: HIJSMM301CIZ7T.16.53.E09.1.454.light.4.raw

SEQ ID NO: 558910 - DNA, 477 bp, Homo sapiens; identical to SEQ ID NO: 545166
  misc_feature: HIJSMM301EW06Q.5.28.C06.1.454.light.4.raw

SEQ ID NO: 558911 - DNA, 498 bp, Homo sapiens; identical to SEQ ID NO: 537098
  misc_feature: HIJSMM301AT640.12.67.G01.1.454.light.4.raw

SEQ ID NO: 558912 - DNA, 479 bp, Homo sapiens
  misc_feature: HIJSMM301BLP5T.40.23.C01.1.454.light.4.raw
tctagcgactcacgaccggtgctcgatttagtacacgtgattagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagacccg

SEQ ID NO: 558913 - DNA, 486 bp, Homo sapiens; identical to SEQ ID NO: 535043
  misc_feature: HIJSMM301CI5T0.46.35.D02.1.454.light.4.raw

SEQ ID NO: 558914 - DNA, 484 bp, Homo sapiens
  misc_feature: HIJSMM301A0LYR.47.60.F05.1.454.light.4.raw
agctcacgtacacgaccggtgctcgatttagtacgtcatcagggaaagggggaggaactgctcagttaggacccagacggaaccatggaagccccagcgcagcttctcttcctcctgctactctggctcccagataccactgacaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgcagtttattactgtcagcagtatcatgactggccgctcaccttcggccaagggacacgactggagattaaacgaactgtggctgcaccat

SEQ ID NO: 558915 - DNA, 476 bp, Homo sapiens; identical to SEQ ID NO: 538611
  misc_feature: HIJSMM301CBI20.7.81.H04.1.454.light.4.raw

SEQ ID NO: 558916 - DNA, 454 bp, Homo sapiens; identical to SEQ ID NO: 535005
  misc_feature: HIJSMM301DDC6Z.19.86.H09.1.454.light.4.raw

SEQ ID NO: 558917 - DNA, 497 bp, Homo sapiens
  misc_feature: HIJSMM301EBORS.40.69.G03.1.454.light.4.raw
tctagcgactcacgaccggtgctcgatttagtcgctgcgtaaaggagaaagggggaggaactgctcagttaggacccagacggaaccatggaagccccagcgcagcttctcttcctcctgctactctggctcccagatagcgctggagaaatagtgatgacgcagtctccagccaccctgtctgtgtctccagggaaaagagccaccctctcctgcagggccagtcagagtgtaaccaacaactacttaatgtggtaccagcaaaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggccgctcactttcggcggagggaccaaggtggagaccaaacgaactgtggctgcaccatctgtctt

SEQ ID NO: 558918 - DNA, 493 bp, Homo sapiens
  misc_feature: HIJSMM301CJLCG.11.81.H04.1.454.light.4.raw
cgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgctagtttttactgtcagcagtatagtaactggcctccgtacacttttggccaggggccaagctagaaatcaaacgaactgtgctgcaccatctgtcttcta

SEQ ID NO: 558919 - DNA, 493 bp, Homo sapiens
  misc_feature: HIJSMM301E13HA.15.3.A03.1.454.light.4.raw
tctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtatcagaaaaaaccaggacagcctcctaagctgctcatttactgggcatctacccgggaatccggggtccctgaccgattcagtggcagcgggtctggcacagatttcactctcaccatcagcagcctgcaggctgaagatgtggcagtttattactgtcagcaatatgaaagtattccttttactttcggccctgggaccgaaaatggatatcaaacgaactgtggctgcaccat

SEQ ID NO: 558920 - DNA, 471 bp, Homo sapiens; identical to SEQ ID NO: 536384
  misc_feature: HIJSMM301EK2M3.18.76.G10.1.454.light.4.raw

SEQ ID NO: 558921 - DNA, 504 bp, Homo sapiens
  misc_feature: HIJSMM301EDPEW.40.67.G01.1.454.light.4.raw
tctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccagggccactggcgtcccggccaggttcagtggcagtgggtctgggacagccttcactctcaccatcagcagcctggagcccgaagattttgcggtttattactgtcagcagcgtgccgactggcccctcacgttcggcggagggaccaaggtggacatcaaacgactgtggctgcaccatctgtcttcatcttcccgcc

SEQ ID NO: 558922 - DNA, 512 bp, Homo sapiens
  misc_feature: HIJSMM301E08H0.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaaggtggaaagtacaaaacgaaactagtggcgtgcgaccatctgtcttctactcttccccg

SEQ ID NO: 558923 - DNA, 470 bp, Homo sapiens
  misc_feature: HIJSMM301AKCO1.51.75.G09.1.454.light.4.raw
cgatcgtatacacgaccggtgctcgatttagtatagacatcaggggtctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcaggtaatgatgtacactggtaccagcagcttccaggaacagtccccaaactcctcatttatgctaacaccaatcggccctcaggggtccctgcccgattctctggctccaggtctggcacctcagcctccctggccatcactgggctccgggctgaggatgaggctgattattactgccagtcccatgacagcagcctgagtgtgctgttcggcggagggaccaag

SEQ ID NO: 558924 - DNA, 488 bp, Homo sapiens; identical to SEQ ID NO: 544026
  misc_feature: HIJSMM301DFPYR.14.55.E11.1.454.light.4.raw

SEQ ID NO: 558925 - DNA, 477 bp, Homo sapiens
  misc_feature: HIJSMM301CIKDD.51.76.G10.1.454.light.4.raw
cgatcgtatacacgaccggtgctcgatttagtcactcatacagggggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggccactgatatcccagccaggttcagtggcagtgggtctgggacagagttcactctcaccatcagcagcctgcagtctgaagattttgcaatttattactgtcagcagtataataactggcctccgtacacttttggccaggggaccaagctggagatcaaacgaactgtggctgcacc

SEQ ID NO: 558926 - DNA, 486 bp, Homo sapiens; identical to SEQ ID NO: 535385
  misc_feature: HIJSMM301ES6HK.19.71.G05.1.454.light.4.raw

SEQ ID NO: 558927 - DNA, 514 bp, Homo sapiens
  misc_feature: HIJSMM301A2L3D.48.80.H03.1.454.light.4.raw
agtatacatacacgaccggtgctcgatttagctgtgcgtcgaagggaaaggggagtctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatccggtcttcggcggagggaccaagttgaccttcctaagtcagcccaaggctgccccctccggtcactctgttcccg

SEQ ID NO: 558928 - DNA, 487 bp, Homo sapiens
  misc_feature: HIJSMM301BAAFQ.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaacggtggatatcagacgaa

SEQ ID NO: 558929 - DNA, 491 bp, Homo sapiens; identical to SEQ ID NO: 542310
  misc_feature: HIJSMM301DMN8L.22.65.F10.1.454.light.4.raw

SEQ ID NO: 558930 - DNA, 483 bp, Homo sapiens; identical to SEQ ID NO: 535317
  misc_feature: HIJSMM301C7ET2.4.1.A01.1.454.light.4.raw

SEQ ID NO: 558931 - DNA, 470 bp, Homo sapiens; identical to SEQ ID NO: 547523
  misc_feature: HIJSMM301D8JQV.5.28.C06.1.454.light.4.raw

SEQ ID NO: 558932 - DNA, 515 bp, Homo sapiens
  misc_feature: HIJSMM301BY4T8.12.71.G05.1.454.light.4.raw
atacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctcctgacaatatctgggctccaggctgaggacgaggctcattactactgctgctcatatggaggttatagcacttgggtgttcggcgcgggaccaaagtgaccgtcctaagtcagcccaaggctgccccctcggcactctgtcccacct

SEQ ID NO: 558933 - DNA, 504 bp, Homo sapiens; identical to SEQ ID NO: 543616
  misc_feature: HIJSMM301BSG90.48.27.C05.1.454.light.4.raw

SEQ ID NO: 558934 - DNA, 479 bp, Homo sapiens
  misc_feature: HIJSMM301DNXSO.51.41.D08.1.454.light.4.raw
cgatcgtatacacgaccggtgctcgatttagtcacgcgagaaagggaaaggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaaactcctgatctatgctgcatccagtttgcaaagtgaggtcccatccaggttcagtggcagtggatctgggacagatttcactctcaccatcagtagtctgcaacctgaagattttgcaacttactactgtcaacagagttacggtaccctgctcactttcggcggagggaccaaggtggagatcaaacgaactatggctgcaccat

SEQ ID NO: 558935 - DNA, 493 bp, Homo sapiens
  misc_feature: HIJSMM301AUVCJ.19.57.F02.1.454.light.4.raw
tactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgcaacttatttttgtcaacaggctaacactttccccctcactttcggtcggagggaccaaggtggaggatcaagcgaactgtggctgcaccatctgtctt

SEQ ID NO: 558936 - DNA, 484 bp, Homo sapiens; identical to SEQ ID NO: 535400
  misc_feature: HIJSMM301EJAP4.46.26.C04.1.454.light.4.raw

SEQ ID NO: 558937 - DNA, 509 bp, Homo sapiens; identical to SEQ ID NO: 543266
  misc_feature: HIJSMM301D4WYD.17.33.C11.1.454.light.4.raw

SEQ ID NO: 558938 - DNA, 447 bp, Homo sapiens; identical to SEQ ID NO: 535020
  misc_feature: HIJSMM301EJHR5.18.9.A09.1.454.light.4.raw

SEQ ID NO: 558939 - DNA, 492 bp, Homo sapiens
  misc_feature: HIJSMM301BHEPP.27.78.H01.1.454.light.4.raw
agcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttactcaagtgatcaccttcggccaagggacacgactggagataaacgaactgtggctgcaccatctgt

SEQ ID NO: 558940 - DNA, 460 bp, Homo sapiens; identical to SEQ ID NO: 537107
  misc_feature: HIJSMM301APBIC.22.28.C06.1.454.light.4.raw

SEQ ID NO: 558941 - DNA, 491 bp, Homo sapiens
  misc_feature: HIJSMM301B0KLF.10.79.H02.1.454.light.4.raw
catagtagtgcacgaccggtgctcgatttagtgtcacacgaagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctggacttttggccaggggaccaagctggagatcaaacgaactgtggctgcacatctgtctt

SEQ ID NO: 558942 - DNA, 494 bp, Homo sapiens; identical to SEQ ID NO: 534992
  misc_feature: HIJSMM301A5TMQ.9.1.A01.1.454.light.4.raw

SEQ ID NO: 558943 - DNA, 482 bp, Homo sapiens; identical to SEQ ID NO: 535796
  misc_feature: HIJSMM301AW2DG.51.64.F09.1.454.light.4.raw

SEQ ID NO: 558944 - DNA, 516 bp, Homo sapiens
  misc_feature: HIJSMM301CI3V3.41.55.E11.1.454.light.4.raw
tctatactatcacgaccggtgctcgatttagcactcgcacgttgggtttggggagtctgggcctaaggaagcagcactggtggtgcctcagccatggcctggaccgttctcctcctcggcctcctctctcactgcacagcctctgtgacctcctatgtgttgactcagccaccctcggcgtcagtggccctaggacagacggccaggattacctgtggggcaaataagataggaactacaaatgtgcactggtaccaacagaggccaggccaggcccctgtggtggtcgtccatgatgattacgaccggccctcaggaatccctgagcgattctctggctccaattctgggaacacggccaccctgaccatcaccggggtcgaggccggggatgaggccacctactattgtcacgtctgggagactggtgatgatcctgtggcgctattcggcggagggacgaagctgaccgtcctgggtcagcccaaggctgccccctcggtcactctgttccca

SEQ ID NO: 558945 - DNA, 505 bp, Homo sapiens
  misc_feature: HIJSMM301CEQE3.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccagataccgaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaaattgagatcaaacgaactgtggctgcaccatctgtcttcatcttcccgcc

SEQ ID NO: 558946 - DNA, 486 bp, Homo sapiens; identical to SEQ ID NO: 537583
  misc_feature: HIJSMM301AU7AK.17.25.C03.1.454.light.4.raw

SEQ ID NO: 558947 - DNA, 503 bp, Homo sapiens; identical to SEQ ID NO: 538583
  misc_feature: HIJSMM301DI4ZH.15.59.F04.1.454.light.4.raw

SEQ ID NO: 558948 - DNA, 476 bp, Homo sapiens
  misc_feature: HIJSMM301AUGMI.49.4.A04.1.454.light.4.raw
agtcgagagacacgaccggtgctcgatttagagtagtgatcaggggagtcccaaccaggacacagcatggacatgagggtccctgctcagctcctggggctcctgctgctctggctctcaggtgccagatgtgtcatccagatgacccagtctccttcctccctgtctgcatctataggagacagaatcaccatcacttgccgggcgagtcgagacattagcatgtatctgaattggtatcagcaaaaaccagggacagcccctaaactcctgatcctcgatgcatccactttggagacaggggtcccatcaaggttcagtggaagtggctctgggacagattttactttcaccatcagcaggctgcagcctgaagataattgcaacatattactgtcaacagtatgatcgtctcccgctcacttcgtcgggggaccggaaggtaggagatcaagacgaactgtggcgtgcgacca

SEQ ID NO: 558949 - DNA, 482 bp, Homo sapiens
  misc_feature: HIJSMM301AFJ7E.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaggtggagatcaacgaa

SEQ ID NO: 558950 - DNA, 514 bp, Homo sapiens; identical to SEQ ID NO: 541418
  misc_feature: HIJSMM301DA3G2.17.33.C11.1.454.light.4.raw

SEQ ID NO: 558951 - DNA, 497 bp, Homo sapiens
  misc_feature: HIJSMM301BVFJI.11.10.A10.1.454.light.4.raw
cgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccaggggaaagagccaccctctcctgcagggccagtcagagtgttaggagcaacttagcctggtaccagcagaaacctggccaggctcccaggctcctcatctatggtgcatccaccagggccactggtttcccagccaggttcagtggcagtgggtctgagacagagttcactctcaccatcaacggcctgcagtctgaagattttgcagtttattactgtcagcagtataataactggcctcggacgttcgaccaagggaccaaggtggaagtacaaacgaactgtggctgcaccatctgtcttctatcttccccg

SEQ ID NO: 558952 - DNA, 504 bp, Homo sapiens
  misc_feature: HIJSMM301BO2DI.22.15.B04.1.454.light.4.raw
acatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacaacacccaggcaaagcccccaaactcatgatttatgaggtcactaagcggccctcaggggtccctgatcgcttctctggctccaagtctggcaacacggcctccctgaccgtctctgggctccaggctgaggatgaggctgattattactgcagctcatatggaggcagcgacaatttggtgttcggcggagggaccaagctgaccgtcctaggtcagcccaaggctgccccctcggtcta

SEQ ID NO: 558953 - DNA, 460 bp, Homo sapiens; identical to SEQ ID NO: 537107
  misc_feature: HIJSMM301BWEU7.22.28.C06.1.454.light.4.raw

SEQ ID NO: 558954 - DNA, 467 bp, Homo sapiens
  misc_feature: HIJSMM301EJ9EO.13.4.A04.1.454.light.4.raw
tcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacaggggtcccatcaaggttcagtggaagtggatctgggacagattttactttctaccatcagcagcctgcagcctgaagatattgcaacatattactgtcagcagtatgataatctcccgatcaccttcggccaagggacacgactggagattaaacgaa

SEQ ID NO: 558955 - DNA, 477 bp, Homo sapiens; identical to SEQ ID NO: 535122
  misc_feature: HIJSMM301EWFVA.26.72.G06.1.454.light.4.raw

SEQ ID NO: 558956 - DNA, 485 bp, Homo sapiens; identical to SEQ ID NO: 535880
  misc_feature: HIJSMM301EMECI.7.75.G09.1.454.light.4.raw

SEQ ID NO: 558957 - DNA, 486 bp, Homo sapiens
  misc_feature: HIJSMM301A99TU.10.2.A02.1.454.light.4.raw
catagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccaccctctcctgcagggccagtcagagtgttggcagcaggttagcctggtaccagcagaaacgtggccaggctcccaggctcctcgtatatggtgcatccaccagggccactggtatctcaggcaggttccgtggcagtgggtctgggacagagttcactgtcaccatcagcagcctgcagtatgaagattttgcagtttattactgtcagcagtataatagctggcccgcgacgttcggccaagggaccgaggtggaattcaaacgaactgtggctgcaccatctgtctt

SEQ ID NO: 558958 - DNA, 486 bp, Homo sapiens; identical to SEQ ID NO: 535917
  misc_feature: HIJSMM301CRMPX.3.10.A10.1.454.light.4.raw

SEQ ID NO: 558959 - DNA, 470 bp, Homo sapiens
  misc_feature: HIJSMM301AMFCO.5.34.D01.1.454.light.4.raw
atcagacacgcacgaccggtgctcgatttagatcgtctgtgttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagttccctccgacctcgtccaacggacacgactggagataaacgaa

SEQ ID NO: 558960 - DNA, 454 bp, Homo sapiens; identical to SEQ ID NO: 534964
  misc_feature: HIJSMM301C0NNA.19.86.H09.1.454.light.4.raw

SEQ ID NO: 558961 - DNA, 494 bp, Homo sapiens
  misc_feature: HIJSMM301AOM58.4.82.H05.1.454.light.4.raw
agcactgtagcacgaccggtgctcgatttagtcgagctctctcgcggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtatacactgatggaaacacctacttgaattggtttcagcagaggccaggccaatctccaaggcgcctaatttataaggtttctaaccgggactctggggtcccagacagattcagcggcagtgggtcaggcactgattacacactgagaatcagcagggtggaggctgaggatgttggggtttattactgcatgcaagggacacactggccgtacacttttggccaggggaccaagctggagatcaaacgaactagtggctgca

SEQ ID NO: 558962 - DNA, 441 bp, Homo sapiens
  misc_feature: HIJSMM301C9E3T.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtatttggcggagggacccacgtaaccgtcctaggtcagcccaaggctgccccctcggtcactctgttcccaccctcctcgtatctctcg

SEQ ID NO: 558963 - DNA, 485 bp, Homo sapiens; identical to SEQ ID NO: 535363
  misc_feature: HIJSMM301D4SL0.17.26.C04.1.454.light.4.raw

SEQ ID NO: 558964 - DNA, 488 bp, Homo sapiens; identical to SEQ ID NO: 536554
  misc_feature: HIJSMM301CS90L.26.37.D04.1.454.light.4.raw

SEQ ID NO: 558965 - DNA, 434 bp, Homo sapiens
  misc_feature: HIJSMM301AS2CI.53.57.F02.1.454.light.4.raw
cgcgtatacacacgaccggtgctcgatttagctcgatatagttgggtttgggtctgctgaagccagttacctcggaaaaagagttggtagctcttgatccggcaaacaaaccaccgctggtagcggtggtttttttgtttgcaagcagcagattacgcgcagaaaaaaggatctcaagaagatcctttgattttctaccgaagaaaggcccacccgtgtaaaacgacggccagtttatctagtcagcttgattctagctgatcgtggaccggaaggtgagccagtgagttgattgcagtccagttacgctggagtctgaggctcgtcctgaatgatatgcggcctctaagcttactgactaggccggccttaattaaggtcagcctaaggctgcccccagcgtcactctgttcccaccctcctctcgtactgcg

SEQ ID NO: 558966 - DNA, 501 bp, Homo sapiens; identical to SEQ ID NO: 537690
  misc_feature: HIJSMM301CYB8R.41.14.B03.1.454.light.4.raw

SEQ ID NO: 558967 - DNA, 493 bp, Homo sapiens
  misc_feature: HIJSMM301BCUSN.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagcccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctactcttttctcttcggaactgggaccacggtcaccgtcctaggtcagcccaaggccaaccc

SEQ ID NO: 558968 - DNA, 487 bp, Homo sapiens; identical to SEQ ID NO: 536272
  misc_feature: HIJSMM301BBAGK.17.25.C03.1.454.light.4.raw

SEQ ID NO: 558969 - DNA, 486 bp, Homo sapiens; identical to SEQ ID NO: 535043
  misc_feature: HIJSMM301D6VDZ.46.35.D02.1.454.light.4.raw

SEQ ID NO: 558970 - DNA, 481 bp, Homo sapiens
  misc_feature: HIJSMM301DXKVV.47.60.F05.1.454.light.4.raw
agctcacgtacacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgcagtttattactgtcagcagtatcatgactggccgctcaccttcggccaagggacacgactggagattaacgaactgtgctgcacat

SEQ ID NO: 558971 - DNA, 483 bp, Homo sapiens; identical to SEQ ID NO: 535413
  misc_feature: HIJSMM301CT62J.26.78.H01.1.454.light.4.raw

SEQ ID NO: 558972 - DNA, 488 bp, Homo sapiens; identical to SEQ ID NO: 537527
  misc_feature: HIJSMM301ESVTD.26.78.H01.1.454.light.4.raw

SEQ ID NO: 558973 - DNA, 497 bp, Homo sapiens; identical to SEQ ID NO: 541552
  misc_feature: HIJSMM301C71Z9.48.82.H05.1.454.light.4.raw

SEQ ID NO: 558974 - DNA, 491 bp, Homo sapiens; identical to SEQ ID NO: 535194
  misc_feature: HIJSMM301AOVWS.26.78.H01.1.454.light.4.raw

SEQ ID NO: 558975 - DNA, 489 bp, Homo sapiens
  misc_feature: HIJSMM301DE157.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtggggtcccatcaaggttcagcggcagtgggtctgggacagaattcactctcaccatcagcagcctgcaacctgatgactttgcaacttattactgccaacagtataatggttatgaatcctacttttggccaagggaccaagctggagatcaaacgaactgtggctgcaca

SEQ ID NO: 558976 - DNA, 494 bp, Homo sapiens; identical to SEQ ID NO: 535276
  misc_feature: HIJSMM301ERL7W.16.6.A06.1.454.light.4.raw

SEQ ID NO: 558977 - DNA, 502 bp, Homo sapiens
  misc_feature: HIJSMM301A9BF4.17.28.C06.1.454.light.4.raw
cgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctcggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggctg

SEQ ID NO: 558978 - DNA, 513 bp, Homo sapiens
  misc_feature: HIJSMM301BQJ1R.5.60.F05.1.454.light.4.raw
atcagacacgcacgaccggtgctcgatttagtacgtcatcagggaaagggtagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctggaagcacctccaacatcggaagtaatattgtaaactggtaccagcagctcccaggaacggcccccaaactcctcatctataggaataatcaacggccctcaggggtccctgaccgattctctggctccaagtctggcacctcagcctccctggccagtccgtgggctccagtctgaggatgagtctgattattactgtgcaacatgggatgacagcctgaatggtccggtattcggcggagggaccaaggctgacccgtccgtcggtcagcccaaggcctgccccctc

SEQ ID NO: 558979 - DNA, 500 bp, Homo sapiens
  misc_feature: HIJSMM301A806J.12.26.C04.1.454.light.4.raw
atacgacgtacacgaccggtgctcgatttagtctagcgactttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttattcaactccaacaatgagaactacttagcttggtaccagcagaaaccaggacagccgcccaagttgctcatttactgggcatctacccgggaatccggggtccctgaccgattcagtggcagcgggtctgagacagatttcactctcaccatcagcagcctgcaggccgaagatgtggcagtttattttgtcagcaatattatcatactccgctcacttttcggcggagggaccaaggtggagatcaaacgaactgtggctgcacca

SEQ ID NO: 558980 - DNA, 506 bp, Homo sapiens
  misc_feature: HIJSMM301EMYCY.19.78.H01.1.454.light.4.raw
tactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaacccccactgtca

SEQ ID NO: 558981 - DNA, 485 bp, Homo sapiens
  misc_feature: HIJSMM301A2J2F.17.26.C04.1.454.light.4.raw
cgtagactagcacgaccggtgctcgatttagtctagcgactttgggtttgggggtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttcagtggcagtggatctgggacagatttcactctcaccatcagcagtctgcaacctgaagattttgcaacttactactgtcaacagagttacaatacccctcggctcactttcggcggagggaccaaggtggagatcaaacgaactgtggctgcaccat

SEQ ID NO: 558982 - DNA, 498 bp, Homo sapiens
  misc_feature: HIJSMM301CB1S2.51.29.C07.1.454.light.4.raw
  modified_base (198)..(198): a, c, t, g, unknown or other
cgatcgtatacacgaccggtgctcgatttagagtgctacgaagggaaagggggaggaactgctcagtcaggacccagacggaaccatggaagccccagcgcagcttctcttcctcctgctactctggctcccagatactactggagaaatagtgatgacgcagtctccagccacgctgtctgtgtctccaggggaaanagccaccctctcctgcagggccagtcagagtgttaacaacaacttagcctggtatcagcagaaacctggccaggctcccaggctcctcatctttggatcatccatcagggccactggtgtcccagaaaagttcagtggcggtgggtctgacacagagtacaccctcaccatcagcaccctgcagtctgaagatgtcgcagtttattactgtcaacaatatagtgacaggccgccatggacgttcggccgaagggaccaaggtggaaataggaaaggaactgtggctgcaccatctgtctt

SEQ ID NO: 558983 - DNA, 530 bp, Homo sapiens
  misc_feature: HIJSMM301C58KZ.49.21.B10.1.454.light.4.raw
agtcgagagacacgaccggtgctcgatttagtgtcgtcgcaagggggctggggtctcaggaggcagcgctcgcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccggaaatgacattggtggttataattttgtctcctggtaccaacaccacccagacaaagcccccagactcattatttatggtgtcggtgaccggccctcaggggtttcgaatcgcttctctggctccaagtccggctacacggcctccctgaccctctctgggctccaggccgaggacgaggctgattattactgcgcctcatatacaaacaacaacatttgggtgttcggcggagggaccaagctgaccgtcctaggtcagcccaaggctgccccctcggtcactctgttcccaccctcctctctctcgta

SEQ ID NO: 558984 - DNA, 496 bp, Homo sapiens
  misc_feature: HIJSMM301AZUMT.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaagggaccgaaacgtaggacgatcaagcgaactagtggctgcaccatctgtt

SEQ ID NO: 558985 - DNA, 489 bp, Homo sapiens; identical to SEQ ID NO: 535139
  misc_feature: HIJSMM301AW6MB.14.55.E11.1.454.light.4.raw

SEQ ID NO: 558986 - DNA, 507 bp, Homo sapiens; identical to SEQ ID NO: 535930
  misc_feature: HIJSMM301DKXON.15.34.D01.1.454.light.4.raw

SEQ ID NO: 558987 - DNA, 486 bp, Homo sapiens; identical to SEQ ID NO: 535523
  misc_feature: HIJSMM301B6RCE.22.73.G07.1.454.light.4.raw

SEQ ID NO: 558988 - DNA, 489 bp, Homo sapiens; identical to SEQ ID NO: 540424
  misc_feature: HIJSMM301BJPNR.17.25.C03.1.454.light.4.raw

SEQ ID NO: 558989 - DNA, 493 bp, Homo sapiens; identical to SEQ ID NO: 535047
  misc_feature: HIJSMM301AKN0E.16.53.E09.1.454.light.4.raw

SEQ ID NO: 558990 - DNA, 488 bp, Homo sapiens; identical to SEQ ID NO: 537260
  misc_feature: HIJSMM301DZG41.47.70.G04.1.454.light.4.raw

SEQ ID NO: 558991 - DNA, 444 bp, Homo sapiens; identical to SEQ ID NO: 535192
  misc_feature: HIJSMM301DH5AR.5.9.A09.1.454.light.4.raw

SEQ ID NO: 558992 - DNA, 479 bp, Homo sapiens; identical to SEQ ID NO: 535118
  misc_feature: HIJSMM301DX0YK.13.59.F04.1.454.light.4.raw

SEQ ID NO: 558993 - DNA, 511 bp, Homo sapiens
  misc_feature: HIJSMM301AQVVL.5.60.F05.1.454.light.4.raw
atcagacacgcacgaccggtgctcgatttagtacgtcatcagggaaaggggagcttcagctgtgggtagagaagacaggactcaggacaatctccagcatggccagcttccctctcctcctcaccctcctcactcactgtgcagggtcctgggcccagtctgtgctgactcagccaccctcagcgtctcgggacccccgggcagagggtcaccatctcttgttctggaagcacctccaacatcggaagtaatattgtaaactggtaccagcagctcccaggaacggcccccaaactcctcatctataggaataatcaacggccctcaggggtccctgaccgattctctggctccaagtctggcacctcagcctccctggccatccgtgggctccagtctgaggatgagtctgattattactgtgcaacatgggatgacagcctgaatggtccggtattcggcggagggaccaagctgaccgtcctcggtcagcccaaggctcgccccctcc

SEQ ID NO: 558994 - DNA, 441 bp, Homo sapiens; identical to SEQ ID NO: 534971
  misc_feature: HIJSMM301B376X.11.3.A03.1.454.light.4.raw

SEQ ID NO: 558995 - DNA, 495 bp, Homo sapiens
  misc_feature: HIJSMM301BYOZR.52.55.E11.1.454.light.4.raw
cgcagtacgacacgaccggtgctcgatttagcactcgcacgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtctgggtcagcccaaggccaacccactgtcactc

SEQ ID NO: 558996 - DNA, 484 bp, Homo sapiens; identical to SEQ ID NO: 538157
  misc_feature: HIJSMM301DK1IQ.26.70.G04.1.454.light.4.raw

SEQ ID NO: 558997 - DNA, 487 bp, Homo sapiens; identical to SEQ ID NO: 536536
  misc_feature: HIJSMM301B3UPN.26.45.E01.1.454.light.4.raw

SEQ ID NO: 558998 - DNA, 476 bp, Homo sapiens
  misc_feature: HIJSMM301A0ZJQ.49.12.B01.1.454.light.4.raw
agtcgagagacacgaccggtgctcgatttagtagtgtagattcgcgaggcagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaaactcttgatctacgatgtctccaatttggaaacaggggtcccatcaaggttcagtggaagtggatctgggacagattttactttcaccatcagcagcctgcagcctgaagatattgcaacatattactgtcaacagtatgataatctcccactcactttcggcggagggaccaaggtggagatcaaacgaactgtggctgcaccat

SEQ ID NO: 558999 - DNA, 499 bp, Homo sapiens
  misc_feature: HIJSMM301CQI38.48.57.F02.1.454.light.4.raw
agtatacatacacgaccggtgctcgatttagctcgatatagttgggtttgggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaatatgcttattggtaccagcagaagtcaggccaggcccctgtgctggtcatctttgaggacaacaaacgaccctccgggatccctgagagattctctggctccagctcagggacaatggccaccttgactatcaatggggcccaggtggacgatgaggctgactactactgttcctcaacagacagtagtggtgatcgagggctgttcggcggagggaccaagctgaccgtcctaagtcagcccaaggctgccccctcggtca

SEQ ID NO: 559000 - DNA, 453 bp, Homo sapiens
  misc_feature: HIJSMM301C29AD.19.86.H09.1.454.light.4.raw
  modified_base (435)..(435): a, c, t, g, unknown or other
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgcccctcggtcactctgttcccnccctcctccacgagagta

SEQ ID NO: 559001 - DNA, 491 bp, Homo sapiens
  misc_feature: HIJSMM301C2JGS.5.41.D08.1.454.light.4.raw
atcagacacgcacgaccggtgctcgatttagtcacgcgagaaagggaaagggggatcaggactcctcagttcaccttctcacaatgaggctccctgctcagctcctggggctgctaatgctctgggtctctggatccagtggggagattgtgctgactcagtctccactctccctgtccgtcacccctggagagccggcctccatctcctgcaggtctagtcagagcctcctgcatagtaatggattcaactatttggattggtacctgcagaggccagggcagtctccacagctcctggtctatttgggctcttatcgggcctccggggtccctgagaggttcagtggcagtggatcaggcacagactttacactgcgaatcagcagagtggaggctgaggatgttggggtttattactgcatgcaagctctacaaaccctattcactttcggccctgggaccagagtggatatcaaacgaaactgtggc

SEQ ID NO: 559002 - DNA, 495 bp, Homo sapiens; identical to SEQ ID NO: 535007
  misc_feature: HIJSMM301AFM9H.22.5.A05.1.454.light.4.raw

SEQ ID NO: 559003 - DNA, 496 bp, Homo sapiens
  misc_feature: HIJSMM301AWMXF.43.28.C06.1.454.light.4.raw
tgtgagtagtcacgaccggtgctcgatttagagctcacgtattgggtttggggtgactgatcaggactcctcagttcaccttctcacaatgaggctccctgctcagctcctggggctgctaatgctctgggtcccaggattaagtggcgaggttgtgatgactcagtctccactctccctgtccgtcacccttggacagccggcctccatctcctgcaggtctagtgaaggcctcctacacagtactggaggcacctacttgagttggtttcaccagaggccaggccaatctccaaggcgtctgatttataagatttctatccgggactctggggtcccagacaggttcagcggcagtgggtcagacactgacttcacactgagaatcagcagggtggaggctgaggatgttggaatttattactgcatgcaatcttcacactggcctccgtacacttttggccagggaccaagctggagatcaaacgaactgtgg

SEQ ID NO: 559004 - DNA, 502 bp, Homo sapiens; identical to SEQ ID NO: 553118
  misc_feature: HIJSMM301A30WI.10.9.A09.1.454.light.4.raw

SEQ ID NO: 559005 - DNA, 481 bp, Homo sapiens
  misc_feature: HIJSMM301CXOT6.41.68.G02.1.454.light.4.raw
tctatactatcacgaccggtgctcgatttagtcgatagtgaagggaaagggggagtcagtcccaaccaggacacagcatggacatgagggtccctgctcagctcctggggctcctgctgctctggctctcaggtgccagatgtgacatccagatgacccagtctccaacctccctgtctgcatctgtaggagacagagtcaccatcacttgtcaggccagtcaggacattagcaactatttaaattggtatcagcagaaaccagggaaagcccctaagctcctgatctacgatgcatccaatttggaatcaggggtcccatcaaggttcagtggaagtggatctgggacagattttactttcaccatcaccagcctgcagcctgaagatattgcaacatattactgtcaacagtatgataatctccctcccactttcggcggagggaccaaggtggagatcaaacgaactgtggctgcacc

SEQ ID NO: 559006 - DNA, 494 bp, Homo sapiens; identical to SEQ ID NO: 535629
  misc_feature: HIJSMM301CUFEC.4.27.C05.1.454.light.4.raw

SEQ ID NO: 559007 - DNA, 482 bp, Homo sapiens; identical to SEQ ID NO: 535796
  misc_feature: HIJSMM301AMTDM.51.64.F09.1.454.light.4.raw

SEQ ID NO: 559008 - DNA, 496 bp, Homo sapiens; identical to SEQ ID NO: 535109
  misc_feature: HIJSMM301AQWLQ.16.78.H01.1.454.light.4.raw

SEQ ID NO: 559009 - DNA, 518 bp, Homo sapiens
  misc_feature: HIJSMM301CKC58.49.26.C04.1.454.light.4.raw
agtcgagagacacgaccggtgctcgatttagtctagcgactttgggtttgggggctgtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgccaaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcacagaggaatattcggcggagggaccaagctgaccgtcctaggtcagcccaaggctgccccctcggtcactctgttcccgccct

SEQ ID NO: 559010 - DNA, 508 bp, Homo sapiens
  misc_feature: HIJSMM301BUSKL.43.67.G01.1.454.light.4.raw
tgtgagtagtcacgaccggtgctcgatttagagtatacatattgggtttgggggagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgttatactccgccgacgtcgccggggaccgaccgtcggaaatacaaacgaactgtggctgcaccatctgtctt

SEQ ID NO: 559011 - DNA, 472 bp, Homo sapiens; identical to SEQ ID NO: 535898
  misc_feature: HIJSMM301EGTHT.15.8.A08.1.454.light.4.raw

SEQ ID NO: 559012 - DNA, 488 bp, Homo sapiens; identical to SEQ ID NO: 536861
  misc_feature: HIJSMM301AGS9J.12.88.H11.1.454.light.4.raw

SEQ ID NO: 559013 - DNA, 491 bp, Homo sapiens; identical to SEQ ID NO: 535194
  misc_feature: HIJSMM301CONXB.26.78.H01.1.454.light.4.raw

SEQ ID NO: 559014 - DNA, 519 bp, Homo sapiens; identical to SEQ ID NO: 544148
  misc_feature: HIJSMM301DP4HV.41.87.H10.1.454.light.4.raw

SEQ ID NO: 559015 - DNA, 454 bp, Homo sapiens; identical to SEQ ID NO: 534964
  misc_feature: HIJSMM301B94IH.19.86.H09.1.454.light.4.raw

SEQ ID NO: 559016 - DNA, 488 bp, Homo sapiens; identical to SEQ ID NO: 535081
  misc_feature: HIJSMM301DH64R.26.23.C01.1.454.light.4.raw

SEQ ID NO: 559017 - DNA, 491 bp, Homo sapiens
  misc_feature: HIJSMM301AKLAR.15.8.A08.1.454.light.4.raw
tctacgtagccacgaccggtgctcgatttagcatactctacagggggaggaactgctcagttaggacccagacggaaccatggaagccccagcgcagcttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtatcccagccaggttcagtggcagtgggtctggcacagagttcactctcaccatcagcagcccgcagtctgaagattttgcagtttattactgtcagcaatataacaagtggccattcactttcggcccacgggaccaaagtggatatcaaacgaactgtggctgcaccatctgtcttcatt

SEQ ID NO: 559018 - DNA, 484 bp, Homo sapiens
  misc_feature: HIJSMM301B0FD6.52.55.E11.1.454.light.4.raw
cgcagtacgacacgaccggtgctcgatttagcactcgcacgttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacgtatccctgatcgcttctcaggctccggctctgggactgagcgctacctcaccatctccagcctccagtctgaggacgagggtgactattactgtcagacgtgggacactggcatttgggtgttcggcggagggaccaagttgaccgtcctaggtcagcccaaggctcg

SEQ ID NO: 559019 - DNA, 517 bp, Homo sapiens
  misc_feature: HIJSMM301DWXF6.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggccctgctgctgctgggtctggccatggtcgcccatggcctgctgcgcccaatggttgcaccgcaaagcggggacccagaccctggagcctcagttggaagcagccgatccagcctgcggagcctgtgggcaggtcagcccaaggccaaccccactgtcactcttcg

SEQ ID NO: 559020 - DNA, 466 bp, Homo sapiens; identical to SEQ ID NO: 535366
  misc_feature: HIJSMM301CMM31.13.4.A04.1.454.light.4.raw

SEQ ID NO: 559021 - DNA, 460 bp, Homo sapiens; identical to SEQ ID NO: 536053
  misc_feature: HIJSMM301COO1R.22.28.C06.1.454.light.4.raw

SEQ ID NO: 559022 - DNA, 494 bp, Homo sapiens; identical to SEQ ID NO: 534992
  misc_feature: HIJSMM301BP44S.9.1.A01.1.454.light.4.raw

SEQ ID NO: 559023 - DNA, 348 bp, Homo sapiens
  misc_feature: HIJSMM301B5JAK.51.20.B09.1.454.light.4.raw
cgatcgtatacacgaccggtgctcgatttagtgtagtgtgaagggacagggtatgatgtacactggtaccagcagcttccaggaacagcccccaaactcctcatttattctaacacccatcggccctcaggggtccctgatcgattctctggctccaagtctggcacctcagcctccctggccatcactggactccaggctgaggatgaggctgattattactgccagtcctatgacatcagcctgagtggttcgtgggtattcggcggagggaccagactgaccgtcctaagtcagcccaaggctgccccctcggtcactctgttcccgccctcctctcgtagcact

SEQ ID NO: 559024 - DNA, 486 bp, Homo sapiens; identical to SEQ ID NO: 552083
  misc_feature: HIJSMM301C0BZO.47.70.G04.1.454.light.4.raw

SEQ ID NO: 559025 - DNA, 394 bp, Homo sapiens
  misc_feature: HIJSMM301D2I34.51.85.H08.1.454.light.4.raw
cgatcgtatacacgaccggtgctcgatttagtatcactcagtcgcgggcgggcggagggtcgccatctcttgttctggaagcagctccaacatcggaagtaatgctgtcaactggtatcaacaactcccaggatcggcccccagactcctcatttttaataatgatcagcgggcctcaggggtccctgaccgattctctgcctccaagtcaggcacctcagcctccctggccatcagtgggctccagtctgaggatgaggctgattattattgtgcagcgtgggatgacagcctgtatatgtctctcttcggaggaggcacccagctgaccgtcctcggtcagcccaaggctgccccctcggtcactctgttcccgccctcctctcgtagcact

SEQ ID NO: 559026 - DNA, 486 bp, Homo sapiens
  misc_feature: HIJSMM301AU5MV.10.1.A01.1.454.light.4.raw
catagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagctcctctccgacaggaataacatccggccctcagggatctcagagagattctctgcatccaggtcaggaagcacagcctccctgaccattactggactccaggctgacgacgaagctgattattactgctcagcatgggacaccggcctcagtgcgtgggttttcggcggagggaccaagctgaccgtccctaggtcagaccccg

SEQ ID NO: 559027 - DNA, 487 bp, Homo sapiens
  misc_feature: HIJSMM301EKGVI.48.19.B08.1.454.light.4.raw
  modified_base (445)..(445): a, c, t, g, unknown or other
agtatacatacacgaccggtgctcgatttagtgagtcagtaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgctgctcatatgcaggcagcctacacttgggtntttcgggcggaggggaccaagctgacccgtcctaggtcacgg

SEQ ID NO: 559028 - DNA, 483 bp, Homo sapiens
  misc_feature: HIJSMM301D96YS.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgaggattttgcaacttattactgtctacaagattacacttaccctgggacgttcggccaagggaccaaggtggaaatacaaacgaaactgtggctgcaccta

SEQ ID NO: 559029 - DNA, 503 bp, Homo sapiens
  misc_feature: HIJSMM301CSPU3.41.35.D02.1.454.light.4.raw
  modified_base (447)..(447): a, c, t, g, unknown or other
tctatactatcacgaccggtgctcgatttagcacacgatagttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggtaccatcagcgatgttgattattataaccttgtctcctggtaccaacaacacccaggcaaagcccccaaactcctgatttatgagggcgatcagcggccctcaggggtttctgatcgcttctctggctccaagtctggcaatacggcctccctgacagtctctcggctccaggcggaggacgaggctgattactactgcttctcatatgcagatactaagtcctgggtnttcggcggagggaccaagctgaccgtcctaggtcagcccaaggctcgccccctggt

SEQ ID NO: 559030 - DNA, 479 bp, Homo sapiens
  misc_feature: HIJSMM301DFX1S.41.5.A05.1.454.light.4.raw
tctatactatcacgaccggtgctcgatttagatagatagacagggggcaggagtcagacccagtcaggacacagcatggacatgagggtccccgctcagctcctggggctcctgctgctctggttcccaggttccagatgcgacatccagctgacccagtctccatcttctgtgtctgcatctgtaggagacagagtcaacatcacttgtcgggcgagtcagggtattaccagctggttagcctggtatcagcagaaaccagggaaagcccctaaactcctgatctatgctgcatccagtttgcaaagtggggtcccatcaagattcagaggcagtggatctgggacagatttcactctcactatcaacagcctgcagcctgaagattttgccacttactattgtcaacaggctgacagtttccccttcaccttcggccaagggacacgactggacattaaacgaactgtggctgcacc

SEQ ID NO: 559031 - DNA, 517 bp, Homo sapiens
  misc_feature: HIJSMM301DLLLW.27.23.C01.1.454.light.4.raw
  modified_base (385)..(385): a, c, t, g, unknown or other
agcgtcgtctcacgaccggtgctcgatttagtacacgtgattagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggntccagcctgaggacgaggctgattattattgtagttcatatacaaccagtgacacttgggtgttcggcggagggaccaggctgaccgtcctaggtcagcccaaggctgcccctcggtcactctgttccacct

SEQ ID NO: 559032 - DNA, 499 bp, Homo sapiens; identical to SEQ ID NO: 539754
  misc_feature: HIJSMM301EOY87.11.21.B10.1.454.light.4.raw

SEQ ID NO: 559033 - DNA, 499 bp, Homo sapiens; identical to SEQ ID NO: 537739
  misc_feature: HIJSMM301A6A1W.12.86.H09.1.454.light.4.raw

SEQ ID NO: 559034 - DNA, 503 bp, Homo sapiens; identical to SEQ ID NO: 538884
  misc_feature: HIJSMM301BOAEJ.27.78.H01.1.454.light.4.raw

SEQ ID NO: 559035 - DNA, 512 bp, Homo sapiens
  misc_feature: HIJSMM301C82BO.43.19.B08.1.454.light.4.raw
tgtgagtagtcacgaccggtgctcgatttagtgagtcagtaaggggagtctgggcctaaggaagcagcactggtggtgcctcagccatggcctggaccgttctcctcctcggcctcctctctcactgcacagggtcggtgacttcctatgtgctgactcagccaccctcggtgtcagtggcccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatccggtcttcggcggagggaccaagttgaccgtcctaagtcagcccaaggctgccccctcggtcactctgttcccaccctcct

SEQ ID NO: 559036 - DNA, 497 bp, Homo sapiens
  misc_feature: HIJSMM301D010L.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaacgcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccctcggtcactctgttcccaccctcctcgagtgcgtct

SEQ ID NO: 559037 - DNA, 502 bp, Homo sapiens
  misc_feature: HIJSMM301D0C5K.49.69.G03.1.454.light.4.raw
agtcgagagacacgaccggtgctcgatttagtcgctgcgtaaaggagaaagggggaggaactgctcagttaggacccagagggaaccatggaagccccagctcagcttctcttcctcctgcttctctggctcccagatattaccggagaaattgtgttgatgcagtctccagccaccctgtctttgtctccaggggaaagagccaccctctcctgcagggccagtcagagtgttaacatctacttagtctggtaccaacagaaagctggccacgctcccaggctcctcatctatgatacatccaccagggcccctggcatcccagccaggttcagtggcagtgggtctgggacagacttcactctcaccatcagcagcttagagcctgaagattttgcagtttattactgtcagcagcgtatcaccgggatcaccttcggccaagggacccgactggagattaagcgaactgtggctgcaccatctgtcttcatcttccccg

SEQ ID NO: 559038 - DNA, 494 bp, Homo sapiens; identical to SEQ ID NO: 557656
  misc_feature: HIJSMM301EXPK3.22.5.A05.1.454.light.4.raw

SEQ ID NO: 559039 - DNA, 503 bp, Homo sapiens; identical to SEQ ID NO: 536834
  misc_feature: HIJSMM301CWZOV.2.35.D02.1.454.light.4.raw

SEQ ID NO: 559040 - DNA, 492 bp, Homo sapiens
  misc_feature: HIJSMM301C9OZK.48.65.F10.1.454.light.4.raw
agtatacatacacgaccggtgctcgatttagctacgctctaaggggggggtcgacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgaggacagtaagcggccctcaggggtttctaatcgcttctctggctccaagtctggcaacacggcctccctgacaatctctgggctccaggctgaggacgaggctgattattactgctgctcatatgcagatagtagcactcatgtggtattcggcggagggaccaagctgaccgtcctaggtcagcccaaggctcg

SEQ ID NO: 559041 - DNA, 510 bp, Homo sapiens; identical to SEQ ID NO: 545115
  misc_feature: HIJSMM301BYW66.19.59.F04.1.454.light.4.raw

SEQ ID NO: 559042 - DNA, 521 bp, Homo sapiens; identical to SEQ ID NO: 545601
  misc_feature: HIJSMM301ARTD0.40.46.E02.1.454.light.4.raw

SEQ ID NO: 559043 - DNA, 487 bp, Homo sapiens
  misc_feature: HIJSMM301EQFI1.22.73.G07.1.454.light.4.raw
acatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagtctggtaccagcagagacctggccaggctcccaggctcctcatctatggtgcttctaccagggccactggtatccccgccaggttcagtgccagtgggtctgggacagagttcactctcaccatcagcagcctgcagtctgaagattttgcactttattactgtcagcaatataatgactggttctcgatcaccttcggccaaggacacgactggagaattaaacgaactgtggctgcaccatctgtt

SEQ ID NO: 559044 - DNA, 488 bp, Homo sapiens
  misc_feature: HIJSMM301ANK2H.41.73.G07.1.454.light.4.raw
tctatactatcacgaccggtgctcgatttagctctacgctcagggcacgaccggtgctcgatttagatcgtctgtgttgggtttggggggagtcagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaccagggaaagcccctaaattcctgatctatcaggcatctaatttggaaagtggggtcccatcaaggtttagcggcagtggatctgggacagaattcactctcacgatcagcggcctgcagcctgatgatgtcgcaacttattactgccaacactatgatagttacccgctcactttcggcggagggaaccg

SEQ ID NO: 559045 - DNA, 491 bp, Homo sapiens; identical to SEQ ID NO: 535294
  misc_feature: HIJSMM301AOWZC.16.68.G02.1.454.light.4.raw

SEQ ID NO: 559046 - DNA, 505 bp, Homo sapiens
  misc_feature: HIJSMM301A4JYU.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctcggcgacgttcggccaaggaccaaggtggaagtcaagcgaactgtggctgcaccatctgtcttcatcttccgcc

SEQ ID NO: 559047 - DNA, 518 bp, Homo sapiens; identical to SEQ ID NO: 539372
  misc_feature: HIJSMM301B1GJB.7.86.H09.1.454.light.4.raw

SEQ ID NO: 559048 - DNA, 487 bp, Homo sapiens
  misc_feature: HIJSMM301C33X7.52.85.H08.1.454.light.4.raw
cgcagtacgacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgacctgactcagccaccctcagtgtccgtgtctccaggacagacagccaccatcacctgctctggagataaattgggggaaaatatgcttgctggtatcaacagcggccaggccagtcccctgtactggtcatctatctgaatagtaggcggccctctgggatccctgaccgattctctggctcccactctgggaacacagccactctgaccatcagcgggacccaggctttggatgaggctgactattactgtcaggcgtgggacaccatcactggagtaatattcggcggagggaccaggctgaccgtctaggtcagccaaggctgccccctcggt

SEQ ID NO: 559049 - DNA, 487 bp, Homo sapiens
  misc_feature: HIJSMM301B4SM3.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcacccatcagcagactggagcctgaagattttgcagtctattactgtcagcagtatggtcacgtcccaagaacttttggccaggggaccaagctggagatcaaacgaactgtggctgcaccat

SEQ ID NO: 559050 - DNA, 483 bp, Homo sapiens; identical to SEQ ID NO: 542318
  misc_feature: HIJSMM301BZ4JR.13.59.F04.1.454.light.4.raw

SEQ ID NO: 559051 - DNA, 509 bp, Homo sapiens
  misc_feature: HIJSMM301BV5PQ.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgtcgtccacgggacgacgacgtagaaatagagacgaacgtagtggctgcaccactctgtcttctactcttcccgt

SEQ ID NO: 559052 - DNA, 493 bp, Homo sapiens; identical to SEQ ID NO: 535084
  misc_feature: HIJSMM301COPRM.47.64.F09.1.454.light.4.raw

SEQ ID NO: 559053 - DNA, 493 bp, Homo sapiens; identical to SEQ ID NO: 536246
  misc_feature: HIJSMM301BO3C5.49.66.F11.1.454.light.4.raw

SEQ ID NO: 559054 - DNA, 503 bp, Homo sapiens
  misc_feature: HIJSMM301C736Z.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaaatatgcttattggtaccagcagaagtcaggccaggccccaaaattggtcatctatgaagacgacaaacgaccctccgggatccctgagagattctctggctccagctcagggactatggccaccttgactatcagtgggcccaagtggaggatgaagctgactactactgttactcaatagagaacagtgataattctgggtgttcggcggagggaccaaactgaccgtcctaggtcagcccaaggctgccccctcggtcactctgtt

SEQ ID NO: 559055 - DNA, 514 bp, Homo sapiens; identical to SEQ ID NO: 538541
  misc_feature: HIJSMM301EU6EM.47.23.C01.1.454.light.4.raw

SEQ ID NO: 559056 - DNA, 503 bp, Homo sapiens
  misc_feature: HIJSMM301D3CYL.3.25.C03.1.454.light.4.raw
  modified_base (490)..(490): a, c, t, g, unknown or other
  modified_base (496)..(496): a, c, t, g, unknown or other
agacgcactccacgaccggtgctcgatttagtagtgtagatttgggtttggggggagtcagactcagtcaggacacagcatggacatgagggtccccgctcagctcctggggctcctgctgctctggctcccaggtgccgagggtgacatccagctgacccagtctccctccaccgtgtctgcattcgtaggagacagagtcaccatcacctgtcgggccagtcagagtattaatagttggttggcctggtatcaccagagaccaggtgaagccccaaaactccttatttatgatgcctccactttgaatagtggggtcccaccaacgttcagcggcagtggatctgggacagagttcactctcaccatcagcagcctgcagcctgatgatcttggaacttattactgccaacaatataatagttattggacgttcggccaggggaccaaggtcgaaatgagacgaactgtggctgcaccatctgtcttnaccctnttccccg

SEQ ID NO: 559057 - DNA, 522 bp, Homo sapiens; identical to SEQ ID NO: 548113
  misc_feature: HIJSMM301DAWPO.27.23.C01.1.454.light.4.raw

SEQ ID NO: 559058 - DNA, 494 bp, Homo sapiens
  misc_feature: HIJSMM301DYOWA.48.75.G09.1.454.light.4.raw
agtatacatacacgaccggtgctcgatttagtatagacatcagggggatcaggacttctcagttcatcttctcaccatgaggctccctgctcagctcctggggctgctaatgctctggatccctggatccactgcgggtgttgtgttgacccaggctcccctgtctctgtccgtcacccctggacagccggccgccatgtcgtgcaattctagtcggagcctcttctatgaggacggcaggacctacttctattggtacatgcagaagccgggccggtctccacagctcctgatgtctgagatttccaggcgattccctggagtgccagagaggttcagtggcagcggagcagggacagagttcacactgaaaatcagccgggtggaggctgaggatgttggcctttattactgcatgcaaggtatcttcctcccatacacttttggcccggggaccgaacggtggagtctcaaaagaactagtggctgcacca

SEQ ID NO: 559059 - DNA, 501 bp, Homo sapiens; identical to SEQ ID NO: 548357
  misc_feature: HIJSMM301CLDSP.19.67.G01.1.454.light.4.raw

SEQ ID NO: 559060 - DNA, 487 bp, Homo sapiens
  misc_feature: HIJSMM301BRLRV.43.61.F06.1.454.light.4.raw
  modified_base (483)..(483): a, c, t, g, unknown or other
tgtgagtagtcacgaccggtgctcgatttagctacgctctaagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcgtccagggaccgacggtggagtgtcaagacgaactagtggcgtgcnccat

SEQ ID NO: 559061 - DNA, 487 bp, Homo sapiens; identical to SEQ ID NO: 541307
  misc_feature: HIJSMM301EXSLI.19.71.G05.1.454.light.4.raw

SEQ ID NO: 559062 - DNA, 505 bp, Homo sapiens
  misc_feature: HIJSMM301DHFDY.51.86.H09.1.454.light.4.raw
cgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggtttcagcagaggccaggccaatctccaagacgcctaatttataaggtttctaaccgggactctggggtcccagacaaattcagcggcagtgggtcaggcactgatttcacactgaaaatcagcagggtggaggctgaggatgttgggatttactactgtatgcaaggtacacactggcctctcactttcggcggagggaccaaggtggagatgaaacgaactgtggctgcaccatctgt

SEQ ID NO: 559063 - DNA, 472 bp, Homo sapiens; identical to SEQ ID NO: 535898
  misc_feature: HIJSMM301EAUPO.15.8.A08.1.454.light.4.raw

SEQ ID NO: 559064 - DNA, 503 bp, Homo sapiens; identical to SEQ ID NO: 540163
  misc_feature: HIJSMM301DECJ8.10.7.A07.1.454.light.4.raw

SEQ ID NO: 559065 - DNA, 516 bp, Homo sapiens
  misc_feature: HIJSMM301BFXNW.22.28.C06.1.454.light.4.raw
acatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttgggtgttcggcggagggaccaggctgaccgtcctaggtcagcccaaggctgtccccccg

SEQ ID NO: 559066 - DNA, 498 bp, Homo sapiens; identical to SEQ ID NO: 535295
  misc_feature: HIJSMM301DW1U7.15.25.C03.1.454.light.4.raw

SEQ ID NO: 559067 - DNA, 462 bp, Homo sapiens
  misc_feature: HIJSMM301DVU2O.15.11.A11.1.454.light.4.raw
tctacgtagccacgaccggtgctcgatttagctacgactgcagggtgggtaagaaatacctgcaactgtcagcctcagcagagctctggggagtctgcaccatggcttggaccccactcctcttcctcaccctcctcctccactgcacagggtctctctcccagcttgtgctgactcaatcgccctctgcctctgcctccctgggagcctcggtcaagctcacctgcactctgagcagtgggcacaccagctacgccatcgcatggcatcagcagcagccagagaagggccctcgctacttgatgaagcttaacactgatggcagccacagtaagggggacgggatccctgatcgcttctcaggctccagctctggggctgagcgctacctcaccatctccagcctccagtctgaggatgaggctgactattactgtcagacctggggcactggcaatagtt

SEQ ID NO: 559068 - DNA, 513 bp, Homo sapiens; identical to SEQ ID NO: 547639
  misc_feature: HIJSMM301C0QUY.43.59.F04.1.454.light.4.raw

SEQ ID NO: 559069 - DNA, 506 bp, Homo sapiens
  misc_feature: HIJSMM301DR3ZJ.48.70.G04.1.454.light.4.raw
agtatacatacacgaccggtgctcgatttagtgtagtgtgaagggaaagggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaagctgctcatttactcggcatccacccggaaatccggagttcctgaccgattccgtggcagcgggtctgggacagattttactctcaccatcagtagcctgcaggctgaagatgtggcagtttattactgtcaacaatattattatactccgccgacgttcggccgggggaccgaacgtggaaatcaaacgaactgtggctgcaccatctgtt

SEQ ID NO: 559070 - DNA, 480 bp, Homo sapiens
  misc_feature: HIJSMM301BEVJO.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggttttggctgttcggcggcgggac

SEQ ID NO: 559071 - DNA, 492 bp, Homo sapiens
  misc_feature: HIJSMM301B48AV.15.67.G01.1.454.light.4.raw
tctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtgggtcccatcaaggttcagcggcagtggatctggcacagatttcactctcaccatcagcagcctgcagcctgaagatttcgcaacttatactgtctacaagattacaattaccctcggacgttcggccgagggaccgaacggtggaaatacaaacgaactagtggcgtcgcaccta

SEQ ID NO: 559072 - DNA, 442 bp, Homo sapiens
  misc_feature: HIJSMM301DEFGZ.47.55.E11.1.454.light.4.raw
agctcacgtacacgaccggtgctcgatttagcactcgcacgtagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctaggtcagcccaaggccaaccccactgtcactctgttcccaccctcctctacgtgagct

SEQ ID NO: 559073 - DNA, 519 bp, Homo sapiens
  misc_feature: HIJSMM301CQLAJ.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccaaggtggcaatcaaccgaactgtggctgcaccatctcgtcttcatcttccccg

SEQ ID NO: 559074 - DNA, 496 bp, Homo sapiens; identical to SEQ ID NO: 548148
  misc_feature: HIJSMM301EODLA.16.10.A10.1.454.light.4.raw

SEQ ID NO: 559075 - DNA, 500 bp, Homo sapiens; identical to SEQ ID NO: 536183
  misc_feature: HIJSMM301EWR3Q.10.17.B06.1.454.light.4.raw

SEQ ID NO: 559076 - DNA, 504 bp, Homo sapiens
  misc_feature: HIJSMM301AYZNY.9.12.B01.1.454.light.4.raw
  modified_base (478)..(478): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaaacagttttctcgggcttcggccaagggaccaaggtggaaagtcaaacgaaactgtggntgcaccatctgtcttcatcttccccg

SEQ ID NO: 559077 - DNA, 489 bp, Homo sapiens
  misc_feature: HIJSMM301DO2W6.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtggggtcccatcaaggttcagcggcagtgggtctgggacagaattcactctcaccatcagcagcctgcaacctgatgactttgcaacttattactgccaacagtataatggttatgaattccacttttggccaagggaccaagctggagatcaaacgaactgtggctgcacc

SEQ ID NO: 559078 - DNA, 494 bp, Homo sapiens; identical to SEQ ID NO: 536221
  misc_feature: HIJSMM301A6DPL.15.59.F04.1.454.light.4.raw

SEQ ID NO: 559079 - DNA, 494 bp, Homo sapiens
  misc_feature: HIJSMM301CLBSP.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggacttttattactgtcagcagcgtgagttctggcctccgctcactttcggcggagggaccgagggtggagatcaaacgaactgtggctgcaccatctgtcttcat

SEQ ID NO: 559080 - DNA, 479 bp, Homo sapiens; identical to SEQ ID NO: 545213
  misc_feature: HIJSMM301A0C5Z.40.59.F04.1.454.light.4.raw

SEQ ID NO: 559081 - DNA, 485 bp, Homo sapiens; identical to SEQ ID NO: 536576
  misc_feature: HIJSMM301CCVLQ.46.35.D02.1.454.light.4.raw

SEQ ID NO: 559082 - DNA, 502 bp, Homo sapiens
  misc_feature: HIJSMM301A10TH.51.28.C06.1.454.light.4.raw
cgatcgtatacacgaccggtgctcgatttagagctcacgtattgggtttgggggaggaactgctcagttaggacccagagggaaccatggaagccccagctcagcttctcttcctcctgctactctggctcccagattccaccggagaaattgtgttgacacagtctccaggcaccctgtctttgtctccaggggaaagagccaccctctcctgcagggccagtcagagtgttagtcacttcttagcctggtaccaacacaaacctggccaggctcccaggctcctcatttatgatgcatccaagagggccactggcgtcccagccaggttcagtggcagtgggtctgggacagacttcactctcaccatcagcagcctagagcctgaagattttgcaatttattactgtcagcagcgtagcaattggcctccctcgatcaccttcggccaagggacacgactggagaataaacgaactgtggctgcaccatctgtcttcta

SEQ ID NO: 559083 - DNA, 482 bp, Homo sapiens
  misc_feature: HIJSMM301AE0FZ.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcactttcggccctcggacgtgagtagcatatgtaagagaactagtggcgtgtcga

SEQ ID NO: 559084 - DNA, 506 bp, Homo sapiens
  misc_feature: HIJSMM301D7A9D.12.18.B07.1.454.light.4.raw
  modified_base (460)..(460): a, c, t, g, unknown or other
atacgacgtacacgaccggtgctcgatttagtcgctgcgtaagggggaggaactgctcagttaggacccagagggaaccatggaagccccagctcagcttctcttcctcctgctactctggctcccagataccaccggagaaattgtgttgactcagtctccagccaccctgtctttgtctccaggggaaagagcaaccctctcctgcagggccagtcagagtgttaacagatacttagcctggtaccagcagagacctggccaggctcccaggctcctcatctatgatacattgaagagggccactggcatctcaggcagattcaatggcagtgggtctgggacagacttcactctcaccctcaccagcctagagcctgaagtattttggaatttattactgtcaacagcgtagcaactggcctcccactttcggcggagggaccaaggtggagtttancaagcgaactgtggctgcaccatctgtcttcattccttcccgccta

SEQ ID NO: 559085 - DNA, 494 bp, Homo sapiens
  misc_feature: HIJSMM301DWLSP.11.81.H04.1.454.light.4.raw
cgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggcccactggtatcccagccaggttcagtggcagtgggtctgggacagagttcactctcaccatcagcagcctgcagtctgaagattttgcagtttttactgtcagcagtatagtaactggcctccgtacacttttggccagggaccaagctagaaatcaaacgaactgtggctgcaccatctgtcttcta

SEQ ID NO: 559086 - DNA, 486 bp, Homo sapiens; identical to SEQ ID NO: 535043
  misc_feature: HIJSMM301CJQCN.46.35.D02.1.454.light.4.raw

SEQ ID NO: 559087 - DNA, 496 bp, Homo sapiens
  misc_feature: HIJSMM301AEP6O.15.67.G01.1.454.light.4.raw
tctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagatttcactctcaccatcagcagcctgcagcctgaagatttcgcaacttattactgtctacaagattacaattaccctcggacgttcgtccgacgggaccggaacggtggaaagtacaaacgaactacgtggcgtgcacca

SEQ ID NO: 559088 - DNA, 502 bp, Homo sapiens; identical to SEQ ID NO: 545036
  misc_feature: HIJSMM301DS5V9.15.57.F02.1.454.light.4.raw

SEQ ID NO: 559089 - DNA, 497 bp, Homo sapiens
  misc_feature: HIJSMM301CI8NB.43.53.E09.1.454.light.4.raw
tgtgagtagtcacgaccggtgctcgatttagagagagtgtgttgggtttggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaaccca

SEQ ID NO: 559090 - DNA, 520 bp, Homo sapiens; identical to SEQ ID NO: 539176
  misc_feature: HIJSMM301C9EUB.27.23.C01.1.454.light.4.raw

SEQ ID NO: 559091 - DNA, 491 bp, Homo sapiens; identical to SEQ ID NO: 537488
  misc_feature: HIJSMM301C9VJA.15.3.A03.1.454.light.4.raw

SEQ ID NO: 559092 - DNA, 506 bp, Homo sapiens
  misc_feature: HIJSMM301APFKC.43.86.H09.1.454.light.4.raw
tgtgagtagtcacgaccggtgctcgatttagtgctatagacttgggtttggggtgatcaggactcctcagttcaccttctcacaatggggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgcctaatttataaggtttctaaccgggactctggggtcccagacagattcagcggcagtgggtctggcactgatttcacactgacaatcagcagggtggaggctgaggatgttgggttttattactgcatgcaaacttcacactggcctccgttcacttttggccaggggaccaaggtggagatcaaacgaactgtggctgcaccatctgt

SEQ ID NO: 559093 - DNA, 487 bp, Homo sapiens
  misc_feature: HIJSMM301EPENU.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgtttcggccaagggaccaaggtggatatcagacgaa

SEQ ID NO: 559094 - DNA, 485 bp, Homo sapiens; identical to SEQ ID NO: 536263
  misc_feature: HIJSMM301D20J1.47.78.H01.1.454.light.4.raw

SEQ ID NO: 559095 - DNA, 491 bp, Homo sapiens
  misc_feature: HIJSMM301CY0MD.22.25.C03.1.454.light.4.raw
acatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagttaccatcacttgccgggccagtcagagtattagtgtctgggtggcctggtatcagcagaaaccagggaaagcccctaaggtcctgatctatgaggcatctactttaaaaactggtgtcccatcaaggttcagcggcagtggatctgggacagaattcactctcgccatcagcagcctgcagcctgatgattctgcaacttattactgccaacagtattatagttatcgggggacttcggccaagggaccaaggtggaaatcaaacgaactgtggctgcaccatctgt

SEQ ID NO: 559096 - DNA, 488 bp, Homo sapiens; identical to SEQ ID NO: 544026
  misc_feature: HIJSMM301ED2G2.14.55.E11.1.454.light.4.raw

SEQ ID NO: 559097 - DNA, 490 bp, Homo sapiens; identical to SEQ ID NO: 535526
  misc_feature: HIJSMM301C5R9J.26.78.H01.1.454.light.4.raw

SEQ ID NO: 559098 - DNA, 521 bp, Homo sapiens; identical to SEQ ID NO: 536990
  misc_feature: HIJSMM301CXQ8D.27.23.C01.1.454.light.4.raw
  modified_base (517)..(517): a, c, t, g, unknown or other

SEQ ID NO: 559099 - DNA, 490 bp, Homo sapiens
  misc_feature: HIJSMM301D8WZ0.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatcccagatgacccagtcgtccatcctcccgtgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtaccccgtacacttttggccaggggaccaaactggacatcaaacgaactgtggctgcaccatctgt

SEQ ID NO: 559100 - DNA, 449 bp, Homo sapiens
  misc_feature: HIJSMM301BMA78.11.86.H09.1.454.light.4.raw
  modified_base (326)..(326): a, c, t, g, unknown or other
cgagagataccacgaccggtgctcgatttagtgctatagacttgggtcctgggcccagtctgtgctgactcagccaccctcagcgtctgggacccccgggcagagggtcatcatctcttgttctggaagcagctctaatatcggaagtaatactgtaaattggtatcaacaactcccaggaacggccccaaactcctcatctatagtaataatcagcggccctcaggggtccctgaccgattctctggctccaagtctggcacctcagcctccctggccatcagtgggctccagtctgatgatgaggctgattattactgtgcagnacctgggatgacaccctgaatggtccttgtgtggttttcggcggagggaccaagctgaccgtcctaggtcagcccaaggctgccccctcggtcactctgttcccgccctcctcgtatctctcg

SEQ ID NO: 559101 - DNA, 498 bp, Homo sapiens
  misc_feature: HIJSMM301DWVWR.13.30.C08.1.454.light.4.raw
tcacgtactacacgaccggtgctcgatttagtctgacgtcaaagggaaaggggcctcggggacccttgggctgatccttggtctcctgctcctcaggctcacctgggcccagtagtgactcactagagtgtgtttctccctctttccaggctcttgggcccagtctgccctgattcagcctcctcccgcgtccgagtctcttggtcagtcagtcaccatctcctaagctggagccagcagtgattttgggagttttgactctgtctcttgggtccagcaacacccagtcacaggccccaaagtcatgctgtgcaatgtcactcttcagtcctcaagagtccctgatttttctctgcctcgaggtcttgcagtccggcctccgaggccatcactggactccaggctgcgggcgaggctgcctctttgtgcttggcaaggcggcctctatgaccatctctggactccaggctgcggacgaggctgattgttggtgctggt

SEQ ID NO: 559102 - DNA, 494 bp, Homo sapiens; identical to SEQ ID NO: 535478
  misc_feature: HIJSMM301A3UAO.10.79.H02.1.454.light.4.raw

SEQ ID NO: 559103 - DNA, 441 bp, Homo sapiens; identical to SEQ ID NO: 535074
  misc_feature: HIJSMM301AYVUL.11.3.A03.1.454.light.4.raw

SEQ ID NO: 559104 - DNA, 498 bp, Homo sapiens; identical to SEQ ID NO: 548544
  misc_feature: HIJSMM301DDQ6Z.22.14.B03.1.454.light.4.raw

SEQ ID NO: 559105 - DNA, 501 bp, Homo sapiens; identical to SEQ ID NO: 536142
  misc_feature: HIJSMM301DTM15.15.1.A01.1.454.light.4.raw

SEQ ID NO: 559106 - DNA, 513 bp, Homo sapiens
  misc_feature: HIJSMM301DW4RP.11.57.F02.1.454.light.4.raw
cgagagataccacgaccggtgctcgatttagctcgatatagttgggtttgggggaggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaaggtggaagtcaagcgaactgtggctgcaccatctgtcttcatcttcccgccta

SEQ ID NO: 559107 - DNA, 513 bp, Homo sapiens
  misc_feature: HIJSMM301D0XWM.43.23.C01.1.454.light.4.raw
tgtgagtagtcacgaccggtgctcgatttagtacacgtgattagggattggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaagcccccaaactcttgatttatgatgtcacttatcggccctcaggggtttcttatcgcttctctggctccaagtctggcaacacggcctccctgaccatctctgggctccaggctgaggacgaggctgattattactgcaactcacttacaacgaccgacacttgcgtattcggcggcgggaccaagctgaccgtcctaggtcagcccaaggctgccccctcggtcactctcg

SEQ ID NO: 559108 - DNA, 489 bp, Homo sapiens; identical to SEQ ID NO: 546040
  misc_feature: HIJSMM301CR9LY.11.12.B01.1.454.light.4.raw

SEQ ID NO: 559109 - DNA, 482 bp, Homo sapiens
  misc_feature: HIJSMM301EU6EC.16.81.H04.1.454.light.4.raw
tgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaactttcggccctgggaccaatgtggatatcaaacgaaactgtggctgcaccatctgt

SEQ ID NO: 559110 - DNA, 504 bp, Homo sapiens
  misc_feature: HIJSMM301A29U4.16.49.E05.1.454.light.4.raw
tgtactactccacgaccggtgctcgatttagagcgactagcaacacacaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttgggggttataaccttgtctcctggtaccagcagcacccagacaaagcccccaaactcatgatttatgagggcaataagcggccctcaggagtttctaatcgcttctctggctccacgtctggcaacacggcctccctgacaatctctggcctccaggctgaggacgaggctgattattactgctgctcatattcaagtcgtgttcactatgctttttggcggagggaccaaggtgaccgtcctaggtcagcccaaggctgccccccg

SEQ ID NO: 559111 - DNA, 493 bp, Homo sapiens; identical to SEQ ID NO: 535745
  misc_feature: HIJSMM301DMIEY.47.78.H01.1.454.light.4.raw

SEQ ID NO: 559112 - DNA, 521 bp, Homo sapiens
  misc_feature: HIJSMM301ATW77.27.23.C01.1.454.light.4.raw
agcgtcgtctcacgaccggtgctcgatttagtacacgtgattagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagccaaggctgccccctcggtcactctgttcccaccct

SEQ ID NO: 559113 - DNA, 496 bp, Homo sapiens
  misc_feature: HIJSMM301B8Z8I.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccctcggtcactctgttcccgccctctccgagtgcgtct

SEQ ID NO: 559114 - DNA, 497 bp, Homo sapiens
  misc_feature: HIJSMM301DBBHE.51.5.A05.1.454.light.4.raw
cgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaagaaatctgctttttggtaccatcagaggccaggccaggcccctgtattggtcatctatgaggacaccaagcgaccctccggaatccctgagagagtcgctggctccaggtcagggacaatggccaccttgactatcactgggacccagatggacgatgaaggtgactaccactgttattcgacagacagcagtggtagtcagggggtcttcggcggagggacgaagctgaccgtcctgagtcagcccaaggctgccccctcggtcactctgtt

SEQ ID NO: 559115 - DNA, 492 bp, Homo sapiens; identical to SEQ ID NO: 536087
  misc_feature: HIJSMM301DMW04.10.17.B06.1.454.light.4.raw

SEQ ID NO: 559116 - DNA, 490 bp, Homo sapiens
  misc_feature: HIJSMM301B1PTH.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgtagtctattactgtcagcagtatggtcacgtcccaagaacttttggccaggggaccaagctggagatcaaacgaactgtggctgcaccatctgt

SEQ ID NO: 559117 - DNA, 478 bp, Homo sapiens; identical to SEQ ID NO: 540986
  misc_feature: HIJSMM301ECII5.16.86.H09.1.454.light.4.raw

SEQ ID NO: 559118 - DNA, 507 bp, Homo sapiens
  misc_feature: HIJSMM301C39H2.17.87.H10.1.454.light.4.raw
cgtagactagcacgaccggtgctcgatttagcagtactgcgttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttgggggttataaccttgtctcctggtaccaacaccacccagacaaagcccccaaactcatcctttatgagggcactaagcggccctcaggggtttctaatcgcttcgctggctccacgtctggcagcacggcctccctgacaatctctgggctccaggctgaggacgaggctgattattactgctgctcatattcaagtcgtgtcactatgatttttggcggaggcaccaaggtgaccgtcctaggtcagcccaaggctgccccctcggtcta

SEQ ID NO: 559119 - DNA, 494 bp, Homo sapiens; identical to SEQ ID NO: 535828
  misc_feature: HIJSMM301BXK52.3.36.D03.1.454.light.4.raw

SEQ ID NO: 559120 - DNA, 509 bp, Homo sapiens
  misc_feature: HIJSMM301EDKJA.19.72.G06.1.454.light.4.raw
  modified_base (477)..(477): a, c, t, g, unknown or other
tactctcgtgcacgaccggtgctcgatttagctacgactgcaagggaaaggggggggtcgcaagaggcagcgctctcgggacgtctccaccatggcctgggctctgctgctcctcactctcctcactcaggacacagggtcctgggcccagtctgccctgactcagcctgcctccgtgtctgagtctcttggacagtcgatcaccatctcctccactgggaccggtcgtgatgttgggacttatacccttgtctcctggtaccaacaataccccggcaaagcccccaaactcctgatttatgaggctcataagcggccctcaggggtttctgagcgcttctctggctccagggctgacaacacggcctacctgacgatctctgggctccaggctgaggacgaggctgactattattgctgcgcatacgcaggaagtagcacatgggtgtgcggcggagggaccaaggtgaccgtccngggtcagcccaaggctgccccctcggtcactc

SEQ ID NO: 559121 - DNA, 488 bp, Homo sapiens; identical to SEQ ID NO: 537673
  misc_feature: HIJSMM301EJF66.12.31.C09.1.454.light.4.raw

SEQ ID NO: 559122 - DNA, 504 bp, Homo sapiens
  misc_feature: HIJSMM301DHPKY.4.57.F02.1.454.light.4.raw
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccgggatgaggccgactattactgtcaggtgtgggatagtagtggtgatcatccatacgtcttcggaactgggaccaaggtctccgtcctacgtcagcccaaggccaactccactgtcactc

SEQ ID NO: 559123 - DNA, 512 bp, Homo sapiens
  misc_feature: HIJSMM301CRNQ2.49.23.C01.1.454.light.4.raw
agtcgagagacacgaccggtgctcgatttagtacacgtgattagggattgggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgccaaaaagatatgcttattggtaccatcagaagtcaggccaggcccctgtactggtcatctatgaggacaccaaacgaccctccgggatccctacgagattctctggctccagtttagggacagtggccaccctgacagtcagtggggcccaggtggaggatgagggtgattactactgttactcaacagacattactactactcatagggtgttcggcggagggaccaagctgaccgtcctaggtcagcccaaggctgccccctcggtcactctgttcccgccct

SEQ ID NO: 559124 - DNA, 505 bp, Homo sapiens; identical to SEQ ID NO: 535503
  misc_feature: HIJSMM301A38RU.8.28.C06.1.454.light.4.raw

SEQ ID NO: 559125 - DNA, 498 bp, Homo sapiens
  misc_feature: HIJSMM301B2X65.51.9.A09.1.454.light.4.raw
cgatcgtatacacgaccggtgctcgatttagcgagacgcgcagggggcgggggtaagaggttgtgtccaccatggcctggactcctctcctcctcctgttcctctctcactgcacaggttccctctcgcaggctgtgctgactcagccgtcttccctgtctgcatctcctggagcatcagccagtctcacctgcaccttgcgcagtggcttcgatgttagtacctacaggatatactggttccagcagaaggcagggagtcctccccagtttctcctaaattacaaatctgactcacgtaagcagcagggctctggagtccccagccgcttctctggatccaaagatgcttcggccaatgcggggatttactcatctctgggctccagtctgaggatgaggctgactattactgtttgatttggcacagcagcgcttgggtattcggcgggggaccgaaactgaccgtcctaggtcagcccaaggctgccccctcggt

SEQ ID NO: 559126 - DNA, 496 bp, Homo sapiens; identical to SEQ ID NO: 536248
  misc_feature: HIJSMM301BP11X.22.27.C05.1.454.light.4.raw

SEQ ID NO: 559127 - DNA, 497 bp, Homo sapiens; identical to SEQ ID NO: 535664
  misc_feature: HIJSMM301CEMVU.22.14.B03.1.454.light.4.raw

SEQ ID NO: 559128 - DNA, 514 bp, Homo sapiens; identical to SEQ ID NO: 541502
  misc_feature: HIJSMM301CWK5B.15.34.D01.1.454.light.4.raw

SEQ ID NO: 559129 - DNA, 491 bp, Homo sapiens
  misc_feature: HIJSMM301B6SDA.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagcggcctgcagtctgaagattttgcagtttattactgtcagcagtataatgactgggttttattcactttcggccctgggaccaaagtggattcagacgaactgtggctgcaccatctgtcttcta

SEQ ID NO: 559130 - DNA, 497 bp, Homo sapiens; identical to SEQ ID NO: 555392
  misc_feature: HIJSMM301B64P7.43.71.G05.1.454.light.4.raw

SEQ ID NO: 559131 - DNA, 444 bp, Homo sapiens
  misc_feature: HIJSMM301D6KS7.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttggggtgtttgggtgttcggcggagggaccaagctgaccgtcctaagtcagcccaaggctgccccctcggtcactctgttcccacctcctccgtgtctgat

SEQ ID NO: 559132 - DNA, 499 bp, Homo sapiens; identical to SEQ ID NO: 543922
  misc_feature: HIJSMM301EIL2V.18.11.A11.1.454.light.4.raw

SEQ ID NO: 559133 - DNA, 518 bp, Homo sapiens
  misc_feature: HIJSMM301DCBBX.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggggcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccacctcctcctacg

SEQ ID NO: 559134 - DNA, 496 bp, Homo sapiens
  misc_feature: HIJSMM301EKAJF.5.57.F02.1.454.light.4.raw
atcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcacgtctccagccatcctgtctgtgtctccaggggagagagccaccctctcctgcagggccagtcagaacattggtagcaacttagcctggtaccaacaaaacctggccagcctcccagactcctcatttatcgttcatccaccagggccactgatgtcccaaccagattcagtggcagagggtctgggacagacttcagtctcaccgtcagcagcgtacagtctgaagacttggcagtttattactgtcaacaatgtggtcagtggcctcgaacgttcggcccagggaccacagtggatatcaggcgaactgtggctgcaccatctgtcttcta

SEQ ID NO: 559135 - DNA, 404 bp, Homo sapiens; identical to SEQ ID NO: 535530
  misc_feature: HIJSMM301ERL79.4.35.D02.1.454.light.4.raw

SEQ ID NO: 559136 - DNA, 508 bp, Homo sapiens
  misc_feature: HIJSMM301DDFUC.52.76.G10.1.454.light.4.raw
cgcagtacgacacgaccggtgctcgatttagtcactcatacaggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttataactctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatacacaaacagaaacacttgggtgttcggcggcgggaccaaactgaccgtcctacgtcagcccaaggctgccccctcggtcactctgttccca

SEQ ID NO: 559137 - DNA, 503 bp, Homo sapiens; identical to SEQ ID NO: 555565
  misc_feature: HIJSMM301DTU89.21.26.C04.1.454.light.4.raw

SEQ ID NO: 559138 - DNA, 505 bp, Homo sapiens; identical to SEQ ID NO: 535503
  misc_feature: HIJSMM301AOVHF.8.28.C06.1.454.light.4.raw

SEQ ID NO: 559139 - DNA, 485 bp, Homo sapiens; identical to SEQ ID NO: 540285
  misc_feature: HIJSMM301AIGM3.46.26.C04.1.454.light.4.raw

SEQ ID NO: 559140 - DNA, 493 bp, Homo sapiens
  misc_feature: HIJSMM301CHXRI.15.67.G01.1.454.light.4.raw
tctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagatttcactctcaccatcagcagcctgcagcctgaagatttcgcaacttattactgtctacaagattacaattaccctcggaccgttcggtccagggaccgaagtggaaagtacaaacgaaacctagtggctgcacca

SEQ ID NO: 559141 - DNA, 485 bp, Homo sapiens
  misc_feature: HIJSMM301B8FXR.5.71.G05.1.454.light.4.raw
atcagacacgcacgaccggtgctcgatttagtgtcgtcgcaagagagagggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtgtcttacacagctccagcaataagaaccacttagcttggtaccagcagaaaccaggacagcctcctaaggtactcatttactgggcatctacccggggatccggggtccctgaccgattcagtggcagcgggtctgggacagatttcactctcaccatcagcagtctgcaggctgaagatgtggcagtttattactgtcagcaatattataccactccgtgcagttttggcctggggaccaagctggagatcaaacgaa

SEQ ID NO: 559142 - DNA, 494 bp, Homo sapiens; identical to SEQ ID NO: 534992
  misc_feature: HIJSMM301ELV9L.9.1.A01.1.454.light.4.raw

SEQ ID NO: 559143 - DNA, 498 bp, Homo sapiens
  misc_feature: HIJSMM301B1KKQ.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatccgcggactggagcctgaagattttgcagtttattactgtcagcagtatggtagctcaccgtacacttttggccaggggaccaagctggagatcaaacgaactgtggctgcaccatcctgtcttcatcttctccg

SEQ ID NO: 559144 - DNA, 491 bp, Homo sapiens; identical to SEQ ID NO: 555196
  misc_feature: HIJSMM301ARWBJ.47.38.D05.1.454.light.4.raw

SEQ ID NO: 559145 - DNA, 493 bp, Homo sapiens; identical to SEQ ID NO: 535084
  misc_feature: HIJSMM301C3N3S.47.64.F09.1.454.light.4.raw

SEQ ID NO: 559146 - DNA, 499 bp, Homo sapiens
  misc_feature: HIJSMM301AL3UB.3.33.C11.1.454.light.4.raw
agacgcactccacgaccggtgctcgatttagagtgagctcgttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctcgccccccg

SEQ ID NO: 559147 - DNA, 512 bp, Homo sapiens
  misc_feature: HIJSMM301BE95Y.19.59.F04.1.454.light.4.raw
tactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggaagaattttgtgtcctggtaccagcagctcccaggaacagcccccaaactcctcatttttgacaataataagcgaccctccagggattcctgaccgattctctggctccaagtctggcacgtcagccaccctgggcatcaccggactccagactggggacgaggccgattattactgcggaacatgggatagcagcctgagtactgtgataatcggcggagggaccaagctgaccgtcctaggtcagcccaaggctgccccctcggtcactctgttcccta

SEQ ID NO: 559148 - DNA, 503 bp, Homo sapiens
  misc_feature: HIJSMM301ECG4A.7.31.C09.1.454.light.4.raw
cgtgtctctacacgaccggtgctcgatttagacgtctcatcaaggaaggaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataagtatgtctcctggtaccaacaacacccaggcaaagcccccaaactcatgatttatgaggtcactaagcggccctcaggggtccctgatcgcttctctggctccaagtctggcaacacggcctccctgaccgtctctgggctccaggctgaagatgaggctgattattactgctgctcatatgcaggccgcaacagtgatctattcggcggagggaccaagctgaccgtcctaggtcagcccaaggctgccccctc

SEQ ID NO: 559149 - DNA, 500 bp, Homo sapiens
  misc_feature: HIJSMM301CCB1H.19.67.G01.1.454.light.4.raw
tactctcgtgcacgaccggtgctcgatttagagtatacatattgggtttgggggtagctcaggaagcagagcctggagcatctccactatggcctgggctccactacttctcaccctcctcgctcactgcacaggttcttgggccaactttatgctgactcagccccactctgtgtcggagtctccggggaagacggtaaccatcttttgcacccacaacagtggcaacattgccagcaattttgtgcagtggtaccagcagcgcccgggcagttcccccaccattgtgatctatgaggataatcaaagaccgtctggggtccctgatcggttctctggctccatcgacagctcctccaactctgcctccctcaccatctctggactgaagactgaggacgaggctgactactactgtcagtcttatgatagccgcggtcatgtggtcttcggcggagggaccaagctgaccgtccaggtcagcccaaggctgccccctc

SEQ ID NO: 559150 - DNA, 519 bp, Homo sapiens
  misc_feature: HIJSMM301BV3AX.12.71.G05.1.454.light.4.raw
  modified_base (57)..(57): a, c, t, g, unknown or other
atacgacgtacacgaccggtgctcgatttagtgtcgtcgcaagagagagggggggtnacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaaagtgaccgtcctaagtcagcccaaggctgccccctcggtcactctgttcccgccct

SEQ ID NO: 559151 - DNA, 504 bp, Homo sapiens; identical to SEQ ID NO: 535561
  misc_feature: HIJSMM301D51IN.4.57.F02.1.454.light.4.raw

SEQ ID NO: 559152 - DNA, 486 bp, Homo sapiens; identical to SEQ ID NO: 535043
  misc_feature: HIJSMM301D4ZR7.46.35.D02.1.454.light.4.raw

SEQ ID NO: 559153 - DNA, 504 bp, Homo sapiens; identical to SEQ ID NO: 538940
  misc_feature: HIJSMM301D22YX.2.35.D02.1.454.light.4.raw

SEQ ID NO: 559154 - DNA, 480 bp, Homo sapiens; identical to SEQ ID NO: 557442
  misc_feature: HIJSMM301DTSQH.8.53.E09.1.454.light.4.raw

SEQ ID NO: 559155 - DNA, 492 bp, Homo sapiens; identical to SEQ ID NO: 534967
  misc_feature: HIJSMM301D2DJ7.47.64.F09.1.454.light.4.raw

SEQ ID NO: 559156 - DNA, 491 bp, Homo sapiens; identical to SEQ ID NO: 535294
  misc_feature: HIJSMM301B9GK9.16.68.G02.1.454.light.4.raw

SEQ ID NO: 559157 - DNA, 493 bp, Homo sapiens; identical to SEQ ID NO: 536471
  misc_feature: HIJSMM301AYQLC.3.71.G05.1.454.light.4.raw

SEQ ID NO: 559158 - DNA, 487 bp, Homo sapiens
  misc_feature: HIJSMM301EJ463.40.83.H06.1.454.light.4.raw
tctagcgactcacgaccggtgctcgatttagatcacgtgcgtcgcggggtccaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttcagcatgggacgcagcctcagtgaatgggtgttcggcggagggaccaaactgtccgtcctaggtcagaccccg

SEQ ID NO: 559159 - DNA, 505 bp, Homo sapiens
  misc_feature: HIJSMM301BE7BD.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggcccaaccccactcgtca

SEQ ID NO: 559160 - DNA, 507 bp, Homo sapiens
  misc_feature: HIJSMM301DK0U3.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgcccctcggtcactctgttccc

SEQ ID NO: 559161 - DNA, 494 bp, Homo sapiens
  misc_feature: HIJSMM301D169G.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcgcgggggaccgaaggtggagttcaaacgaactgtggctgcaccatctgtcttcatt

SEQ ID NO: 559162 - DNA, 481 bp, Homo sapiens; identical to SEQ ID NO: 535061
  misc_feature: HIJSMM301BLQJU.16.81.H04.1.454.light.4.raw

SEQ ID NO: 559163 - DNA, 494 bp, Homo sapiens; identical to SEQ ID NO: 534994
  misc_feature: HIJSMM301C4M5H.27.78.H01.1.454.light.4.raw

SEQ ID NO: 559164 - DNA, 497 bp, Homo sapiens; identical to SEQ ID NO: 536376
  misc_feature: HIJSMM301ECSHX.22.9.A09.1.454.light.4.raw

SEQ ID NO: 559165 - DNA, 447 bp, Homo sapiens; identical to SEQ ID NO: 535020
  misc_feature: HIJSMM301BQ3JW.18.9.A09.1.454.light.4.raw

SEQ ID NO: 559166 - DNA, 507 bp, Homo sapiens
  misc_feature: HIJSMM301A055X.48.15.B04.1.454.light.4.raw
agtatacatacacgaccggtgctcgatttagacagtatatatccgcgggggctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaaactactcatttactcggcatccacccggaagtccgaggttcctgaccgattccgtggcagcgggtctgggacagattttactctcaccatcactaccctgcaggctgaagatgtggcagtttattactgtcaacaatattattctactccgccgacgttcggccgggggaccaacgtggaaatcaaacgaactgtggctgcaccatctgtcttcatt

SEQ ID NO: 559167 - DNA, 493 bp, Homo sapiens
  misc_feature: HIJSMM301EF6WI.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcggtcggagggaccgaaggtaggagatcaaacgaaccta

SEQ ID NO: 559168 - DNA, 479 bp, Homo sapiens
  misc_feature: HIJSMM301DG4WJ.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactaccctctcactttcgcgggggaccaaggtggagatcaaacgaactgtggctgcacca

SEQ ID NO: 559169 - DNA, 476 bp, Homo sapiens; identical to SEQ ID NO: 537368
  misc_feature: HIJSMM301BR588.7.83.H06.1.454.light.4.raw

SEQ ID NO: 559170 - DNA, 462 bp, Homo sapiens; identical to SEQ ID NO: 549716
  misc_feature: HIJSMM301BISCS.11.73.G07.1.454.light.4.raw

SEQ ID NO: 559171 - DNA, 490 bp, Homo sapiens
  misc_feature: HIJSMM301AYQGJ.43.33.C11.1.454.light.4.raw
tgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctcccccctacaatttcggtcagggaccaattgaacatcaatcgaactgtggctgcaccatctgtctt

SEQ ID NO: 559172 - DNA, 483 bp, Homo sapiens; identical to SEQ ID NO: 535317
  misc_feature: HIJSMM301BQ4A9.4.1.A01.1.454.light.4.raw

SEQ ID NO: 559173 - DNA, 494 bp, Homo sapiens
  misc_feature: HIJSMM301CU9KG.10.79.H02.1.454.light.4.raw
catagtagtgcacgaccggtgctcgatttagtgtcacacgaagggaaagggggagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtagtcacctgggacttttggccaggggaccaagctggagatcaaacgaactgtggctgcaccatctgtcttcta

SEQ ID NO: 559174 - DNA, 510 bp, Homo sapiens
  misc_feature: HIJSMM301A2UGD.47.83.H06.1.454.light.4.raw
agctcacgtacacgaccggtgctcgatttagatcacgtgcgtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgccccctcggtcactctcgtt

SEQ ID NO: 559175 - DNA, 505 bp, Homo sapiens
  misc_feature: HIJSMM301B0CHJ.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtggttcggcggagggaccaaaactgaccgtcctaggtcagcccaaa

SEQ ID NO: 559176 - DNA, 508 bp, Homo sapiens
  misc_feature: HIJSMM301ECE5C.40.53.E09.1.454.light.4.raw
tctagcgactcacgaccggtgctcgatttagagagagtgtgttgggtttggggggtagagaagacaggactcaggacaatctccagcatggccagcttccctctcctcctcaccctcctcactcactgtgcagggtcctgggcccagtctgtgctgactcagccaccctcagcgtctgggacccccggtcagagggtcaccatctcttgttctggaagcagatccaacatcggaagtaatactgtaaactggtaccagcagctcccaggaacggcccccaaactcctcatctatgataatagtcaccggccctcaggggtacctgaccgattctctggctccaagtctggcacctcagcctccctggccatcagtgggctccagtctgaggatgaggctgattatcactgtgcatcctgggatgacagcctgaatggttgggtgttcggcgggggaccgaagctgaccgtcctaagtcagcccaaggctgccccctcggtcactctcg

SEQ ID NO: 559177 - DNA, 485 bp, Homo sapiens; identical to SEQ ID NO: 550102
  misc_feature: HIJSMM301D6K2A.41.50.E06.1.454.light.4.raw

SEQ ID NO: 559178 - DNA, 446 bp, Homo sapiens
  misc_feature: HIJSMM301BFD5D.47.85.H08.1.454.light.4.raw
agctcacgtacacgaccggtgctcgatttagtatcactcagtcgcggggtcctgggcccagtctgccccgactcagcctgcctccgtgtctgggtctcctggacagtcgatcaccatctcctgcactggaaccagtagtgacgttggcagttctgattcttatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgccccctcggtcactctgttcccaccctcctctacgtgagct

SEQ ID NO: 559179 - DNA, 383 bp, Homo sapiens
  misc_feature: HIJSMM301BBNSY.41.26.C04.1.454.light.4.raw
tctatactatcacgaccggtgctcgatttagtctagcgactttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcattttcccgccatctgaatagtataga

SEQ ID NO: 559180 - DNA, 485 bp, Homo sapiens; identical to SEQ ID NO: 536075
  misc_feature: HIJSMM301DB0OO.17.21.B10.1.454.light.4.raw

SEQ ID NO: 559181 - DNA, 518 bp, Homo sapiens
  misc_feature: HIJSMM301DCXE2.40.27.C05.1.454.light.4.raw
tctagcgactcacgaccggtgctcgatttagacgcgatcgaagggtttggggagcttcagctgtggtggagaagacaggattcaggccaatctccagcatggccggcttccctctcctcctcaccctcctcactcactgtgcagggtcctgggcccagtctgtgctgactcagccaccctcagcgtctgagacccccgggcagcaggttaccgtctcttgttctggaagcagctccaacatcggaagtaattctgtatactggtaccagtgcctcccaggaacggcccccaaacttctcgtctatagggattatcagcggcccttaggggtccctgaccgattctctggctccaggtctggcacctcagcctccctggccatcagtgggctccggcccgaggatgaggcggattattattgtgtgtcatgggatgacagaatgaatggtccggtgttcggcggagggaccaggctgaccgtcctaggtcagcccaaggctgccccctggtcactctcg

SEQ ID NO: 559182 - DNA, 507 bp, Homo sapiens
  misc_feature: HIJSMM301D15DZ.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctcctgaccatctctgggctcgagtctgaggacgaggctgattacttctgttgctcttgggcaactactgtcgtttgggtgttcggcggagggaccaagttgaccgtcctaggtcagccaaggctgccccctcggtcactctgtt

SEQ ID NO: 559183 - DNA, 484 bp, Homo sapiens
  misc_feature: HIJSMM301DG0Y7.10.3.A03.1.454.light.4.raw
catagtagtgcacgaccggtgctcgatttagagagcgtcacagcatggacatgagggtccccgctcagctcctgggactcctgctgctctggctcccaggtgccaaatgtgacatccagatggcccagtctccttccaccctgtctgcttctgtgggggacagagtcatcatcacttgccgggccagtcagacgtttaataattggttggcctggtatcagaagaaaccagggaaagcccccgaaactcctgatccatactgcctccactttggcaagtggggtcccatcaaggttcagcggcagtggagctgggacagagttcactctcagtatcagcagcctgcagcctgatgattttgcaacctattattgtcaacaatatgacacttatccattctctttcggccctgggaccaaagtggattccaaacgaactgtggctgcaccatctgtcttcatcttcccgccatctgacactacta

SEQ ID NO: 559184 - DNA, 497 bp, Homo sapiens; identical to SEQ ID NO: 536371
  misc_feature: HIJSMM301EN774.16.78.H01.1.454.light.4.raw

SEQ ID NO: 559185 - DNA, 501 bp, Homo sapiens
  misc_feature: HIJSMM301B7HTO.9.12.B01.1.454.light.4.raw
  modified_base (429)..(429): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttcncgggcgttcggccaagggaccaaggtggaaatcaacgaactagtggctgcaccatctgtcttcatcttcccg

SEQ ID NO: 559186 - DNA, 494 bp, Homo sapiens; identical to SEQ ID NO: 534994
  misc_feature: HIJSMM301D26XT.27.78.H01.1.454.light.4.raw

SEQ ID NO: 559187 - DNA, 508 bp, Homo sapiens
  misc_feature: HIJSMM301AOFGY.8.33.C11.1.454.light.4.raw
ctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctcgggaccaaggtggagatcaaacgaactgtggctgcaccatctgtcttcta

SEQ ID NO: 559188 - DNA, 498 bp, Homo sapiens
  misc_feature: HIJSMM301CHKXT.52.37.D04.1.454.light.4.raw
cgcagtacgacacgaccggtgctcgatttagtagcatactgttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctcctcctcagggacaacagtcacgttgatcatcagtggagtccgggcagaggacgaggctgactattactgtcaatcaacagacagtagtggtacttatgtgcagttcggcggagggaccaagctgaccgtcctaggtcagcccaaggctgccccctcggtcta

SEQ ID NO: 559189 - DNA, 477 bp, Homo sapiens
  misc_feature: HIJSMM301BYP8D.4.32.C10.1.454.light.4.raw
agcactgtagcacgaccggtgctcgatttagtatagacatcaacacacaaagggggcaggagtcagactcagtcaggacacagcatggacatgagggtccccgctcagctcctggggctcctgctgctctggctcccaggtgccaaatgtgacatccagctgacccagtctccctccaccctgtctgcatctataggagacagagtcaccatcacttgccgggccagtcagagtattagtaactggttggcctggtatcagcagaaaccaggcaaagccccaaagctccttatctctgatgcctccactttgcacggtggcgtcccaccaacgttcagcggcagtggatctgggacagaattcactctcaccatcagcagcctgcagcctgatgatgttgcaacttattactgtcaacaatataacaattattggacgttcggccaagggaccaaggtggaaatcaaacgaactagt

SEQ ID NO: 559190 - DNA, 447 bp, Homo sapiens; identical to SEQ ID NO: 535020
  misc_feature: HIJSMM301DYZGF.18.9.A09.1.454.light.4.raw

SEQ ID NO: 559191 - DNA, 486 bp, Homo sapiens
  misc_feature: HIJSMM301D0RVN.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaaggaccaaggtggatatcagacgaa

SEQ ID NO: 559192 - DNA, 493 bp, Homo sapiens; identical to SEQ ID NO: 540903
  misc_feature: HIJSMM301CU3H1.10.20.B09.1.454.light.4.raw

SEQ ID NO: 559193 - DNA, 493 bp, Homo sapiens
  misc_feature: HIJSMM301DERIL.3.26.C04.1.454.light.4.raw
agacgcactccacgaccggtgctcgatttagtctagcgactttgggtttggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtctccatcacttgccgggccagtcagagtattagtcgctggttggcctggtatcagcagaaaccagggaaagcccctaagctcctgatctatcaggcgtctagtttacaaagtggggtcccatcaaggttcagcggcagtggatctgggacagaattcactctcaccatcagcagcctgcagcctgatgattttgcaacttattactgccaacagtataatacttattggacgttcggccaagggaccaaggtggaaatcaaacgaactagtggctgcaccatctgtcttcta

SEQ ID NO: 559194 - DNA, 487 bp, Homo sapiens
  misc_feature: HIJSMM301ASMBY.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcgaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaa

SEQ ID NO: 559195 - DNA, 488 bp, Homo sapiens
  misc_feature: HIJSMM301DO2U7.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagttttattattgtcaacaatattattatacttcgtggacgtttcggccaagggaccaaggtggatatcagacgaa

SEQ ID NO: 559196 - DNA, 494 bp, Homo sapiens
  misc_feature: HIJSMM301BTRIE.3.10.A10.1.454.light.4.raw
agacgcactccacgaccggtgctcgatttagcgtcgatctcagggggtgggtccaggaggcagaactctgggtgtctcaccatggcccggatccctctacttcctccccctcctcactctctgcacagactctgaggcctcctatgagctgacacagccaccctcggtgtcagtcgtccccaggacagacggccaagatcacctgctctggagatgcattgccaaagcaatatgcttattggtaccaaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcaccgtcctaggtcagcccaaggccaaccccactgt

SEQ ID NO: 559197 - DNA, 494 bp, Homo sapiens; identical to SEQ ID NO: 534992
  misc_feature: HIJSMM301BE6JS.9.1.A01.1.454.light.4.raw

SEQ ID NO: 559198 - DNA, 520 bp, Homo sapiens; identical to SEQ ID NO: 535773
  misc_feature: HIJSMM301BDLB9.41.19.B08.1.454.light.4.raw

SEQ ID NO: 559199 - DNA, 485 bp, Homo sapiens; identical to SEQ ID NO: 535501
  misc_feature: HIJSMM301EPVQ8.3.10.A10.1.454.light.4.raw

SEQ ID NO: 559200 - DNA, 443 bp, Homo sapiens
  misc_feature: HIJSMM301E2C7X.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctgccccctggtcactctgttcccgccctcctccgtgtctgat

SEQ ID NO: 559201 - DNA, 507 bp, Homo sapiens; identical to SEQ ID NO: 539752
  misc_feature: HIJSMM301AQ7MM.11.1.A01.1.454.light.4.raw

SEQ ID NO: 559202 - DNA, 496 bp, Homo sapiens; identical to SEQ ID NO: 545357
  misc_feature: HIJSMM301EKEIJ.43.49.E05.1.454.light.4.raw

SEQ ID NO: 559203 - DNA, 488 bp, Homo sapiens; identical to SEQ ID NO: 542699
  misc_feature: HIJSMM301B4ZVN.12.51.E07.1.454.light.4.raw

SEQ ID NO: 559204 - DNA, 493 bp, Homo sapiens
  misc_feature: HIJSMM301BKLMW.51.80.H03.1.454.light.4.raw
cgatcgtatacacgaccggtgctcgatttagctgtgcgtcgaaggagggagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaactcatgatttatgaggtcagtaagcggccctcaggggtccctgatcgcttctctggctccaagtctggcaacacggcctccctgaccgtctctgggctccaggctgaggatgaggctgattattactgctgctcacatgcaggcagcatcggtgtgctattcggcggagggaccaagctgaccgtcctaggtcagcccaaggctgccccctcggtcactctcg

SEQ ID NO: 559205 - DNA, 486 bp, Homo sapiens; identical to SEQ ID NO: 535043
  misc_feature: HIJSMM301DNQGA.46.35.D02.1.454.light.4.raw

SEQ ID NO: 559206 - DNA, 494 bp, Homo sapiens; identical to SEQ ID NO: 534994
  misc_feature: HIJSMM301C5DVJ.27.78.H01.1.454.light.4.raw

SEQ ID NO: 559207 - DNA, 496 bp, Homo sapiens; identical to SEQ ID NO: 537925
  misc_feature: HIJSMM301BOTDT.22.14.B03.1.454.light.4.raw

SEQ ID NO: 559208 - DNA, 487 bp, Homo sapiens; identical to SEQ ID NO: 537009
  misc_feature: HIJSMM301DEF7C.12.88.H11.1.454.light.4.raw

SEQ ID NO: 559209 - DNA, 508 bp, Homo sapiens
  misc_feature: HIJSMM301A2CFE.51.86.H09.1.454.light.4.raw
cgatcgtatacacgaccggtgctcgatttagtgctatagacttgggtttggggtgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggtttcagcagaggccaggccaatctccaagacgcctaatttataaggtttctaaccgggactctggggtcccagacagattcagcggcagtgggtcaggcactgatttcacactgataatcgacagggtggaggctgaggatgttgggttttattactgcatgcaaggtacacactggcctgggacgttcggccaagggaccaaggtggaaatcaaacgaactgtggctgcacatctgtcttcta

SEQ ID NO: 559210 - DNA, 489 bp, Homo sapiens
  misc_feature: HIJSMM301BLVMJ.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacacgtacccccctcactttcggcggaggaccaaggcggagatcagacgaactgtggctgcaccatctgtcttcta

SEQ ID NO: 559211 - DNA, 504 bp, Homo sapiens; identical to SEQ ID NO: 535561
  misc_feature: HIJSMM301CF0KW.4.57.F02.1.454.light.4.raw

SEQ ID NO: 559212 - DNA, 489 bp, Homo sapiens; identical to SEQ ID NO: 537952
  misc_feature: HIJSMM301EXNCU.4.27.C05.1.454.light.4.raw

SEQ ID NO: 559213 - DNA, 498 bp, Homo sapiens; identical to SEQ ID NO: 544690
  misc_feature: HIJSMM301EJ2QX.41.6.A06.1.454.light.4.raw

SEQ ID NO: 559214 - DNA, 505 bp, Homo sapiens; identical to SEQ ID NO: 546412
  misc_feature: HIJSMM301AO1AK.22.21.B10.1.454.light.4.raw

SEQ ID NO: 559215 - DNA, 486 bp, Homo sapiens; identical to SEQ ID NO: 536555
  misc_feature: HIJSMM301AR2K9.26.23.C01.1.454.light.4.raw

SEQ ID NO: 559216 - DNA, 496 bp, Homo sapiens; identical to SEQ ID NO: 537225
  misc_feature: HIJSMM301EPQY5.11.59.F04.1.454.light.4.raw

SEQ ID NO: 559217 - DNA, 514 bp, Homo sapiens
  misc_feature: HIJSMM301A3UG8.5.58.F03.1.454.light.4.raw
atcagacacgcacgaccggtgctcgatttagtctgatcgagaagggaaagggggggtcgacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcacacttttatgtttcgggactgggaccaaggtcaccgtcctaggtcagcccaaggccaaccccactgtcactcttcg

SEQ ID NO: 559218 - DNA, 491 bp, Homo sapiens
  misc_feature: HIJSMM301ELTP6.47.70.G04.1.454.light.4.raw
  modified_base (365)..(365): a, c, t, g, unknown or other
agctcacgtacacgaccggtgctcgatttagtgtagtgtgaagggaaagggggaaggtcagtctcagtcaggacacagcatggacatgagggtccccgcctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctnaccatcagcagtctgcaacctgaagattttgcaacttactactgtcaacagagttacggtaccccgtacacttttggccagggaccaaactggacatcaaaccgaactgtggctgcaccatctgtt

SEQ ID NO: 559219 - DNA, 496 bp, Homo sapiens
  misc_feature: HIJSMM301C8J4K.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagtattttgctactttattactgtcagcagcgtagcaactggcctctcactttcggcgggacgggaccgagggtggagatcagacgaactgtggctgcaccatctgtt

SEQ ID NO: 559220 - DNA, 497 bp, Homo sapiens; identical to SEQ ID NO: 535664
  misc_feature: HIJSMM301DWJQF.22.14.B03.1.454.light.4.raw

SEQ ID NO: 559221 - DNA, 516 bp, Homo sapiens
  misc_feature: HIJSMM301CQUXC.9.14.B03.1.454.light.4.raw
tgatacgtctcacgaccggtgctcgatttagtgtgagtagttccgcgggggtgggctcaggaggcagagctctgggaatctcaccatggcctggacccctctcctgctccccctcctcactttctgcacagtctctgaggcctcctatgatctgacacagccaccctcggtgtcagtgtccccaggacagacggccaggatcacctgctctggagatggattatcaaaaaaatatgtttattggtaccaacagaagtcaggccaggccccccttctagtcatctatgaggacgccaggcgaccctccgggatccctgagagaatctcgggctccagttcagggacagtggccaccttgacgatcggtggggcccaggtggaagatgaagctgactacttctgttactcaacagacgacagtgcggatcatagagggatgttcggcggagggaccaagctgaccgtcctaggtcagcccaaggctgccccctcggtcactctgttcccaccctcctc

SEQ ID NO: 559222 - DNA, 499 bp, Homo sapiens
  misc_feature: HIJSMM301CWRTO.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgccccgtcacccttggacaggtggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccaagggaccaaggtggaaatcaaacgaactgtggctgcacc

SEQ ID NO: 559223 - DNA, 446 bp, Homo sapiens; identical to SEQ ID NO: 536034
  misc_feature: HIJSMM301D4LL4.18.9.A09.1.454.light.4.raw

SEQ ID NO: 559224 - DNA, 519 bp, Homo sapiens; identical to SEQ ID NO: 544155
  misc_feature: HIJSMM301C0F3Y.19.80.H03.1.454.light.4.raw

SEQ ID NO: 559225 - DNA, 485 bp, Homo sapiens; identical to SEQ ID NO: 535880
  misc_feature: HIJSMM301A8BUY.7.75.G09.1.454.light.4.raw

SEQ ID NO: 559226 - DNA, 505 bp, Homo sapiens; identical to SEQ ID NO: 535503
  misc_feature: HIJSMM301CLSUV.8.28.C06.1.454.light.4.raw

SEQ ID NO: 559227 - DNA, 486 bp, Homo sapiens; identical to SEQ ID NO: 535385
  misc_feature: HIJSMM301BNOSH.19.71.G05.1.454.light.4.raw

SEQ ID NO: 559228 - DNA, 506 bp, Homo sapiens
  misc_feature: HIJSMM301C2KLJ.13.55.E11.1.454.light.4.raw
tcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctccctgtctgcatctgtaggagacagagtcaccatcacttgccgggcaagtcagagcattaccaactatttgaattggtatcaacaaaaaccagggagagcccctcacctccttatctatggtgcatccaccttacaaagtggggtcccatcaaggttcagtggcactggatctgggacagatttcactctcaccatcagcagtctgcaacctgaagattttgcaacttattactgtcaacagagtttcagtacgcggacgttcgccaaggaccaacggtggaaatacaaacgaacgtacgtggctgcaccaactctgtcttctactcttccccg

SEQ ID NO: 559229 - DNA, 519 bp, Homo sapiens; identical to SEQ ID NO: 553954
  misc_feature: HIJSMM301DF8JR.41.19.B08.1.454.light.4.raw

SEQ ID NO: 559230 - DNA, 508 bp, Homo sapiens
  misc_feature: HIJSMM301BAL25.15.86.H09.1.454.light.4.raw
tctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcacgg

SEQ ID NO: 559231 - DNA, 511 bp, Homo sapiens
  misc_feature: HIJSMM301AYU2W.43.33.C11.1.454.light.4.raw
tgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctcctccccctacctatacgttcggacggacgggaactagtacaactatacaatacgtaacgttggtcgctcgaccaacctattctcgttt

SEQ ID NO: 559232 - DNA, 518 bp, Homo sapiens; identical to SEQ ID NO: 537995
  misc_feature: HIJSMM301B5M03.5.27.C05.1.454.light.4.raw

SEQ ID NO: 559233 - DNA, 521 bp, Homo sapiens; identical to SEQ ID NO: 539470
  misc_feature: HIJSMM301A17KR.27.23.C01.1.454.light.4.raw

SEQ ID NO: 559234 - DNA, 487 bp, Homo sapiens; identical to SEQ ID NO: 537079
  misc_feature: HIJSMM301BOBFX.14.55.E11.1.454.light.4.raw

SEQ ID NO: 559235 - DNA, 501 bp, Homo sapiens; identical to SEQ ID NO: 536818
  misc_feature: HIJSMM301AL6O4.12.82.H05.1.454.light.4.raw

SEQ ID NO: 559236 - DNA, 485 bp, Homo sapiens; identical to SEQ ID NO: 536263
  misc_feature: HIJSMM301EBCSB.47.78.H01.1.454.light.4.raw

SEQ ID NO: 559237 - DNA, 487 bp, Homo sapiens
  misc_feature: HIJSMM301CY78R.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcggcggagggaccgaaggtggagatacaacgaa

SEQ ID NO: 559238 - DNA, 504 bp, Homo sapiens
  misc_feature: HIJSMM301CLL1M.17.41.D08.1.454.light.4.raw
cgtagactagcacgaccggtgctcgatttagtcacgcgagaaagggaaaggggagagctgctcagttaggacccagagggaaccatggaaaccccagcgcagcttctcttcctcctgctactctggctcccagataccaccggagaaattgtgttgacgcagtctccaggcaccctgtccttgtctccaggggaaacagccaccctctcctgtagggccagtcagagtgtttttaaaaactatttagcctggtaccaacagaagcctggccaggctcccaggctcctcatctatggtgcatccaccagggccactggcatcccagacaggttcagtggcggtgggtctgggacagaattcactctcaccatcaccagtctggagcctgaagattttgctctgtatcactgtcagcaatatggtggtacacccctcactttcggcggagggccaaggtggagatcaagcgaactgtggctgcaccatctgtcttcatcttcccgc

SEQ ID NO: 559239 - DNA, 522 bp, Homo sapiens
  misc_feature: HIJSMM301B1BVP.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggccgacggaccgaacggtaggaaggtacaaacggaactacgtaggcgtgcgaccactctgtcttctactcttcccgtccctact

SEQ ID NO: 559240 - DNA, 486 bp, Homo sapiens; identical to SEQ ID NO: 535043
  misc_feature: HIJSMM301DLCK5.46.35.D02.1.454.light.4.raw

SEQ ID NO: 559241 - DNA, 489 bp, Homo sapiens; identical to SEQ ID NO: 535139
  misc_feature: HIJSMM301DCN2F.14.55.E11.1.454.light.4.raw

SEQ ID NO: 559242 - DNA, 489 bp, Homo sapiens; identical to SEQ ID NO: 535139
  misc_feature: HIJSMM301B96AH.14.55.E11.1.454.light.4.raw

SEQ ID NO: 559243 - DNA, 493 bp, Homo sapiens; identical to SEQ ID NO: 540880
  misc_feature: HIJSMM301A9RDI.40.81.H04.1.454.light.4.raw

SEQ ID NO: 559244 - DNA, 489 bp, Homo sapiens; identical to SEQ ID NO: 535091
  misc_feature: HIJSMM301EE5RC.47.36.D03.1.454.light.4.raw

SEQ ID NO: 559245 - DNA, 477 bp, Homo sapiens
  misc_feature: HIJSMM301AOVY1.41.24.C02.1.454.light.4.raw
tctatactatcacgaccggtgctcgatttagtacagatcgttagggaaaggggctgggcctcaggaagcagcatcggaggtgcctcagccatggcatggatccctctcttcctcggcgtccttgcttactgcacaggatctgtggcctcctttgagctgactcagccaccctcagtgtccgtgtccccaggacagacagccagcatcacctgctctggagataaattggggaataaatatgcttcctggtatcagcagaagccaggccagtcccctgtgctggtcatctatcaaagttcccagcggccctcagggatccctgagcgattctctggctccaattctgggaacacagccactctgaccatcagcgggacccaggctatcgatgaggctgagtattactgtcaggcgtgggacatcagcactgaggtggtattcggcggagggaccaagctgaccgtccttggtcagccc

SEQ ID NO: 559246 - DNA, 485 bp, Homo sapiens; identical to SEQ ID NO: 551345
  misc_feature: HIJSMM301DXRT2.40.83.H06.1.454.light.4.raw

SEQ ID NO: 559247 - DNA, 516 bp, Homo sapiens
  misc_feature: HIJSMM301BWYXV.53.6.A06.1.454.light.4.raw
cgcgtatacacacgaccggtgctcgatttagatctactgacaggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggaaagtcggccagatttacctgtgagggaaggcacattgaaactaaaagtgtgcactggtaccagaagaagccaggccaggcccctgtggtggtcgtctatgatgatagcgaccggccctcagggatccctgagcgattctctggctccagctctgggaacacggccaccctgaccatccacagggtcgaatccggggatgaggccgactatttttgtcaggtgtgggatagccttagtgaccaaccggtgttcggcggagggaccaagctggccgtcctaggtcagcccaaggctgccccctcggtcactctgttcccaccctcctctcgta

SEQ ID NO: 559248 - DNA, 488 bp, Homo sapiens; identical to SEQ ID NO: 537260
  misc_feature: HIJSMM301CJ6YT.47.70.G04.1.454.light.4.raw

SEQ ID NO: 559249 - DNA, 496 bp, Homo sapiens; identical to SEQ ID NO: 553139
  misc_feature: HIJSMM301AHH0F.3.33.C11.1.454.light.4.raw
  modified_base (478)..(478): a, c, t, g, unknown or other

SEQ ID NO: 559250 - DNA, 466 bp, Homo sapiens; identical to SEQ ID NO: 536398
  misc_feature: HIJSMM301BSVMU.3.20.B09.1.454.light.4.raw

SEQ ID NO: 559251 - DNA, 488 bp, Homo sapiens; identical to SEQ ID NO: 535990
  misc_feature: HIJSMM301AZMR8.11.28.C06.1.454.light.4.raw

SEQ ID NO: 559252 - DNA, 484 bp, Homo sapiens; identical to SEQ ID NO: 550726
  misc_feature: HIJSMM301CRI6B.47.62.F07.1.454.light.4.raw

SEQ ID NO: 559253 - DNA, 509 bp, Homo sapiens; identical to SEQ ID NO: 541168
  misc_feature: HIJSMM301DDPGC.5.60.F05.1.454.light.4.raw

SEQ ID NO: 559254 - DNA, 447 bp, Homo sapiens; identical to SEQ ID NO: 535020
  misc_feature: HIJSMM301DCWBV.18.9.A09.1.454.light.4.raw

SEQ ID NO: 559255 - DNA, 487 bp, Homo sapiens; identical to SEQ ID NO: 557246
  misc_feature: HIJSMM301ATWX6.51.29.C07.1.454.light.4.raw

SEQ ID NO: 559256 - DNA, 490 bp, Homo sapiens; identical to SEQ ID NO: 549171
  misc_feature: HIJSMM301BGG1A.11.12.B01.1.454.light.4.raw

SEQ ID NO: 559257 - DNA, 511 bp, Homo sapiens; identical to SEQ ID NO: 557489
  misc_feature: HIJSMM301DF4H5.41.9.A09.1.454.light.4.raw

SEQ ID NO: 559258 - DNA, 513 bp, Homo sapiens
  misc_feature: HIJSMM301EHXV6.51.87.H10.1.454.light.4.raw
cgatcgtatacacgaccggtgctcgatttagcagtactgcgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacagaaacacttgggtgttcggcggcgggaccaaactgaccgtcctacgtcagcccaaggctgccccctcggtcactctgtt

SEQ ID NO: 559259 - DNA, 508 bp, Homo sapiens
  misc_feature: HIJSMM301AP6Q4.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaaggaccaaggtggaagtcaagcgaactgtggctgcaccatctgtcttcatcttccagcca

SEQ ID NO: 559260 - DNA, 326 bp, Homo sapiens
  misc_feature: HIJSMM301D3I8D.51.53.E09.1.454.light.4.raw
cgatcgtatacacgaccggtgctcgatttagagagagtgtgttgggtttggggagcttcagctgtggtagagaagacaggattcaggacaatctccagcatggccggcttccctctcctcctcaccctcctcactcactgtgcagggtcctgggcccggtctgtgctgactcagccaccctcaacgtctgggacccccgggcaaagggtcaccatgtcttgttctggaagctgctccaatatcgtcactccttatgtgtactgacaccaggtcagcccaaggctgccccctcggtcactctgttcccaccctcctctcgtagcact

SEQ ID NO: 559261 - DNA, 477 bp, Homo sapiens
  misc_feature: HIJSMM301CGJHH.7.76.G10.1.454.light.4.raw
cgtgtctctacacgaccggtgctcgatttagtcactcatacagggggcaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagcccctaaactcctgatctctgctgcatccagtttacaaagtggggtcccatcgcggttcagcggcagtggatatgggacatatttcactctcgccatcagcagcctgcagcctgaagattttgcaacttactattgtcaacaggctaacagtttcccgctcaccttcgcgggggaccaaggtggagatcaaacgaactgtggctgcacc

SEQ ID NO: 559262 - DNA, 496 bp, Homo sapiens; identical to SEQ ID NO: 535109
  misc_feature: HIJSMM301EDTYP.16.78.H01.1.454.light.4.raw

SEQ ID NO: 559263 - DNA, 500 bp, Homo sapiens
  misc_feature: HIJSMM301EUVUU.17.27.C05.1.454.light.4.raw
  modified_base (494)..(494): a, c, t, g, unknown or other
cgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtcatttatggtaagaataaccggccctcagggatcccagaccgattctctggctccgactcaggaaagacagcttccctgaccatcactggggctcaggcggaagatgaggctgactattactgtaactcccgggacagcagtgctgaccaggtggtattcggcggagggacccacctgaccgtcttaggtcagccaaggctgcccccncggtca

SEQ ID NO: 559264 - DNA, 504 bp, Homo sapiens; identical to SEQ ID NO: 539690
  misc_feature: HIJSMM301CLPQE.47.65.F10.1.454.light.4.raw

SEQ ID NO: 559265 - DNA, 493 bp, Homo sapiens
  misc_feature: HIJSMM301CJ2OZ.40.22.B11.1.454.light.4.raw
tctagcgactcacgaccggtgctcgatttagacgacagctcaggggctgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgaatagtaatggatacaactatttggattggtacctgcagaagccagggcagtgtccacagctcctgatctatttgggttctaatcgggcctccggggtccctgacaggttcagtggcagtggatcaggtacagattttacactgaaaatcagcagagtggaggctgaggatgttggggtttattactgcatgcaagctctacaaattcctcggacgttcggccaagggaccaaggtggaaatcaaacgaactagtggctgcacca

SEQ ID NO: 559266 - DNA, 504 bp, Homo sapiens
  misc_feature: HIJSMM301DF306.5.24.C02.1.454.light.4.raw
  modified_base (448)..(448): a, c, t, g, unknown or other
atcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatntgatcttcggcggggggaccaagctgacgtcctaggtcagcccaaggctgcccccg

SEQ ID NO: 559267 - DNA, 476 bp, Homo sapiens
  misc_feature: HIJSMM301EHCD9.8.49.E05.1.454.light.4.raw
ctcgcgtgtccacgaccggtgctcgatttagagcgactagcaacacacaaagggggcaggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttgccgggcaagtcagagcattggcacctacttaaattggtatcagcagaaaccagggaaagcccccaaactcctgatcaattatgcatccagtttgcaaagtgggtcccatcaagattcagtggcggtggatctgggacagatttcactctcaccatcaacagtctgcagattgaggattatgcaacttattactgtcagcagagttccaggacccccgctcacttttcggcggggggaccaaagtggacgtcaaacgaa

SEQ ID NO: 559268 - DNA, 497 bp, Homo sapiens; identical to SEQ ID NO: 559114
  misc_feature: HIJSMM301DSQU5.51.5.A05.1.454.light.4.raw

SEQ ID NO: 559269 - DNA, 466 bp, Homo sapiens; identical to SEQ ID NO: 536398
  misc_feature: HIJSMM301A56AW.3.20.B09.1.454.light.4.raw

SEQ ID NO: 559270 - DNA, 483 bp, Homo sapiens; identical to SEQ ID NO: 542200
  misc_feature: HIJSMM301DGXRB.7.75.G09.1.454.light.4.raw

SEQ ID NO: 559271 - DNA, 488 bp, Homo sapiens; identical to SEQ ID NO: 535990
  misc_feature: HIJSMM301ENHMQ.11.28.C06.1.454.light.4.raw

SEQ ID NO: 559272 - DNA, 484 bp, Homo sapiens
  misc_feature: HIJSMM301BE4YJ.49.7.A07.1.454.light.4.raw
agtcgagagacacgaccggtgctcgatttagcacgtgtcgcaggggccttcaggccataatgagcgtctctgttttcagggtctctctcccagcctgtggtgactcaatcatcctctgcctctgcttccctgggatcctcggtcaagctcacctgcactctgagcagtgggcacagtacctacatcatcgcatggcataccagcagccagggaaggcccctcggtacttgatgaagcttgaacgtagtggaagcaacaacatggggggcggagttcctgatcgcttctcaggctccagttctgggcctgacttctacctcaccatctccagcctccagtctgaggatgaggctgattattactgtgagacctgggacagtaacactcatactccctcattcggcggagggaccaagctgaccgtcctaggtcagcccaaggctgccccctcggtcactctttcccgccctcctctctctcgact

SEQ ID NO: 559273 - DNA, 521 bp, Homo sapiens; identical to SEQ ID NO: 539470
  misc_feature: HIJSMM301D98IE.27.23.C01.1.454.light.4.raw

SEQ ID NO: 559274 - DNA, 479 bp, Homo sapiens
  misc_feature: HIJSMM301CTYEW.11.11.A11.1.454.light.4.raw
cgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctcctaaactgctcatctcctgggcatctacccgggcacccggagtccctgacccgattcagtggcagcgggtctgggacagacttcactctcaccatcagcaacctgcaggctgaagatgtggcagtttattactgtcagcagtattgtgaagctccgctcactttcggcggagggaccgcggtggagatcagacgaactgtggctgcaccatctgtctt

SEQ ID NO: 559275 - DNA, 488 bp, Homo sapiens; identical to SEQ ID NO: 535861
  misc_feature: HIJSMM301CRH9G.14.55.E11.1.454.light.4.raw

SEQ ID NO: 559276 - DNA, 447 bp, Homo sapiens; identical to SEQ ID NO: 535020
  misc_feature: HIJSMM301CKEMZ.18.9.A09.1.454.light.4.raw

SEQ ID NO: 559277 - DNA, 492 bp, Homo sapiens
  misc_feature: HIJSMM301BPWJ4.48.55.E11.1.454.light.4.raw
agtatacatacacgaccggtgctcgatttagcactcgcacgttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctgccccccg

SEQ ID NO: 559278 - DNA, 488 bp, Homo sapiens
  misc_feature: HIJSMM301ALU2G.26.45.E01.1.454.light.4.raw
agactatactcacgaccggtgctcgatttagtgagtcagtaagggaaaggggtgatcaggactcctcagttcaccttctcacaatgaggctccctgctcagctcctggggctgctaatgctctgggtctctggatccagtggagatattgtgatggctcagtctccactctccctgcccgtcacccctggagagccggcctccatctcctgcaggtctagtcagagcgtcctgcatagtagtggatacaactatttggattggtacctgcagaagccagggcagtctccacagctcctgatctatttggcttctaatcgggcctccggggtccctgacaggttcagtggcagtggatcagacacagattttacactgaaaatcagtagagtggaggctgaggatgttggagtttattactgcatgcaagctctacaaactcctctcactttcggcggagggaccaaggtggagatcaaacgaaactgt

SEQ ID NO: 559279 - DNA, 496 bp, Homo sapiens
  misc_feature: HIJSMM301EGQYM.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaactgtggctgcacccatctgtcttt

SEQ ID NO: 559280 - DNA, 446 bp, Homo sapiens
  misc_feature: HIJSMM301AR43X.10.76.G10.1.454.light.4.raw
catagtagtgcacgaccggtgctcgatttagtcactcatacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgatttattactgccactcctatgacaacagcctgagtatttggctgttcggcggcgggaccaagttgaccgtcctacgtcagcccaaggctgccccctcggtcactctcgttcccccctcctcccactactatg

SEQ ID NO: 559281 - DNA, 508 bp, Homo sapiens
  misc_feature: HIJSMM301EQO7Y.19.72.G06.1.454.light.4.raw
tactctcgtgcacgaccggtgctcgatttagctacgactgcaagggaaagggggggtcggcaagaggcagcgctctcgggacgtctccaccatggcctgggctctgctgctcctcactctcctcactcaggacacagggtcctgggcccagtctgccctgactcagcctgcctccgtgtctgagtctcttggacagtcgatcaccatctcctccactgggaccggtcgtgatgttgggacttatacccttgtctcctggtaccaacaataccccggcaaagcccccaaactcctgatttatgaggctcataagcggccctcaggggtttctgagcgcttctctggctccagggctgacaacacggcctacctgacgatctctgggctccaggctgaggacgaggctgactattattgctgcgcatacgcaggaagtagcacatgggtgtgcggcggagggaccaaggtgaccgtcctgggtcagcccaaggctgccccctcggtcact

SEQ ID NO: 559282 - DNA, 490 bp, Homo sapiens; identical to SEQ ID NO: 541567
  misc_feature: HIJSMM301EN375.22.65.F10.1.454.light.4.raw

SEQ ID NO: 559283 - DNA, 472 bp, Homo sapiens; identical to SEQ ID NO: 535992
  misc_feature: HIJSMM301AGD0Z.11.76.G10.1.454.light.4.raw

SEQ ID NO: 559284 - DNA, 492 bp, Homo sapiens; identical to SEQ ID NO: 540272
  misc_feature: HIJSMM301B7C7N.41.23.C01.1.454.light.4.raw

SEQ ID NO: 559285 - DNA, 492 bp, Homo sapiens; identical to SEQ ID NO: 553285
  misc_feature: HIJSMM301C6WL5.10.77.G11.1.454.light.4.raw

SEQ ID NO: 559286 - DNA, 492 bp, Homo sapiens
  misc_feature: HIJSMM301B2UZB.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaagggaccaaagtaggacatcaagcgaactgtggctgcaccatctgtt

SEQ ID NO: 559287 - DNA, 492 bp, Homo sapiens
  misc_feature: HIJSMM301A3NJS.21.55.E11.1.454.light.4.raw
tcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattatttgccggacaagtcacgacataaacacctttttaaattggtatcagcacaaaccagggaaggccccaaagctcctgatcgatgctgcatccaatttagagagtggggtcccatccaggttcagtggcgatggatctgggacaaatttcactctcaccatcagcagtctgcaacctgaagattttgcaacttactaattgtcaacagagttacagtattccttttcacttttcggccctgggaccgaagtcgatatcaaacgaactgtggctgcaccatctgtt

SEQ ID NO: 559288 - DNA, 485 bp, Homo sapiens; identical to SEQ ID NO: 535501
  misc_feature: HIJSMM301AQ6CZ.3.10.A10.1.454.light.4.raw

SEQ ID NO: 559289 - DNA, 509 bp, Homo sapiens; identical to SEQ ID NO: 539359
  misc_feature: HIJSMM301CMUJA.47.85.H08.1.454.light.4.raw

SEQ ID NO: 559290 - DNA, 504 bp, Homo sapiens
  misc_feature: HIJSMM301DOFEB.9.53.E09.1.454.light.4.raw
  modified_base (472)..(472): a, c, t, g, unknown or other
tgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactccccgtggtattcggcggagggaccaaggtnaccgtcctaggtcagcccaaggctgccccccg

SEQ ID NO: 559291 - DNA, 481 bp, Homo sapiens; identical to SEQ ID NO: 535061
  misc_feature: HIJSMM301C1F5V.16.81.H04.1.454.light.4.raw

SEQ ID NO: 559292 - DNA, 489 bp, Homo sapiens
  misc_feature: HIJSMM301B2Y0O.11.12.B01.1.454.light.4.raw
cgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccccctgtcctactcatctttcaaataccaggcggccctctggggtccctgagcgattctccggctccggctctgggaacacagtcactctgaccatcagcgggacccaggctattgatgaggctgtctacttctgtcaggcgtgggacaacagcgtggtgttcggcggagggaccagtctgaccgtcttaggtcagccaaggc

SEQ ID NO: 559293 - DNA, 496 bp, Homo sapiens; identical to SEQ ID NO: 556864
  misc_feature: HIJSMM301BLN09.51.30.C08.1.454.light.4.raw

SEQ ID NO: 559294 - DNA, 486 bp, Homo sapiens; identical to SEQ ID NO: 535043
  misc_feature: HIJSMM301A7KPE.46.35.D02.1.454.light.4.raw

SEQ ID NO: 559295 - DNA, 476 bp, Homo sapiens; identical to SEQ ID NO: 538611
  misc_feature: HIJSMM301DCVTC.7.81.H04.1.454.light.4.raw

SEQ ID NO: 559296 - DNA, 492 bp, Homo sapiens; identical to SEQ ID NO: 543155
  misc_feature: HIJSMM301ADRZ1.10.53.E09.1.454.light.4.raw

SEQ ID NO: 559297 - DNA, 502 bp, Homo sapiens; identical to SEQ ID NO: 541971
  misc_feature: HIJSMM301DGLRA.4.39.D06.1.454.light.4.raw

SEQ ID NO: 559298 - DNA, 486 bp, Homo sapiens; identical to SEQ ID NO: 535043
  misc_feature: HIJSMM301AHYUU.46.35.D02.1.454.light.4.raw

SEQ ID NO: 559299 - DNA, 509 bp, Homo sapiens
  misc_feature: HIJSMM301ATPWQ.17.28.C06.1.454.light.4.raw
cgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggctgcccccc

SEQ ID NO: 559300 - DNA, 506 bp, Homo sapiens
  misc_feature: HIJSMM301CN93B.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggagggaccaagggtggagatcaaacgaactgtggctgcaccatctgt

SEQ ID NO: 559301 - DNA, 487 bp, Homo sapiens
  misc_feature: HIJSMM301CSWDZ.4.27.C05.1.454.light.4.raw
agcactgtagcacgaccggtgctcgatttagacgcgatcgaagggtttgggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcgtcctacatagtaatggatacaactatttggattggtacctgcagaagccagggcagtctccacagctcctgatctatttgggttctaaccgggcctccggggtccctgacaggttcagtggcagtggatcaggcacagattttacactgagaatcagcagagtggaggctgaggatggttggggtttactactgcatgcaagctctacaagccacctacacttttggccaggggaaccaggctggagatacaaacgaact

SEQ ID NO: 559302 - DNA, 505 bp, Homo sapiens
  misc_feature: HIJSMM301ECHG9.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaaattgagatcaaacgaactgtggctgcaccatctgtcttcatcttcccgcca

SEQ ID NO: 559303 - DNA, 507 bp, Homo sapiens
  misc_feature: HIJSMM301C46H6.16.1.A01.1.454.light.4.raw
tgtactactccacgaccggtgctcgatttagacgtctcatcagggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggtcggagggaccaagctgaccgtcctaggtcagccaaggctgccccctccggtcactctgtt

SEQ ID NO: 559304 - DNA, 453 bp, Homo sapiens
  misc_feature: HIJSMM301B1ON5.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggaagacggtcaccatcgcttgttctgcaagcagctcgaacatcgggagcagtggtgtgatgtggtatcagaaagtcccaggaacggccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcgcaaggctgccccctcggtcactctgttcccaccctcctccacgagagta

SEQ ID NO: 559305 - DNA, 511 bp, Homo sapiens
  misc_feature: HIJSMM301ARIHF.15.34.D01.1.454.light.4.raw
tctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctgactcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtggggcgtggcatttgggtgttcggcggagggaccaaactgaccgtcctaggtcagcccaaggctgccccctcggtcactctcg

SEQ ID NO: 559306 - DNA, 362 bp, Homo sapiens
  misc_feature: HIJSMM301CWGD8.3.57.F02.1.454.light.4.raw
agacgcactccacgaccggtgctcgatttagctcgatatagttgggtttggggggtgtggtggtctccactcccgccttgacggggctgctatctgccttccaggcccctatcctggtcatcaattatgacagcgaccggccctcagggatccctgagcgattctctggctccaactctgggaacacggccaccctgaccatcaccagggtcgaggccgaggatgaggccgactattactgtcaggtgtgggatagccgttctgatcattgggtcttcggcggcgggaccaagctgaccgtcctatgtcaacccaaggctggcccctcggtcactctgttcccgccctcctcgagtgcgtct

SEQ ID NO: 559307 - DNA, 477 bp, Homo sapiens
  misc_feature: HIJSMM301B3N1A.43.13.B02.1.454.light.4.raw
tgtgagtagtcacgaccggtgctcgatttagtctagcgacttccgcggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagcccaac

SEQ ID NO: 559308 - DNA, 465 bp, Homo sapiens
  misc_feature: HIJSMM301C20QJ.13.4.A04.1.454.light.4.raw
tcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacaggggtcccatcaaggttcagtggaagtggatctgggacagattttatttcaccatcagcagcctgcagcctgaagatattgcaacatattactgtcagcagtatgataatctcccgatcaccttcggccaagggacacgactggagattaaacgaa

SEQ ID NO: 559309 - DNA, 481 bp, Homo sapiens; identical to SEQ ID NO: 535993
  misc_feature: HIJSMM301BSS3B.21.25.C03.1.454.light.4.raw

SEQ ID NO: 559310 - DNA, 482 bp, Homo sapiens; identical to SEQ ID NO: 535216
  misc_feature: HIJSMM301DXZ2F.17.26.C04.1.454.light.4.raw

SEQ ID NO: 559311 - DNA, 494 bp, Homo sapiens; identical to SEQ ID NO: 535276
  misc_feature: HIJSMM301AS62L.16.6.A06.1.454.light.4.raw

SEQ ID NO: 559312 - DNA, 484 bp, Homo sapiens
  misc_feature: HIJSMM301ERYDY.52.83.H06.1.454.light.4.raw
cgcagtacgacacgaccggtgctcgatttagatcacgtgcgtcgcggggagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaattatttaaattggtatcagcagaaaccagggaaagcccctaaactcctgatctacgatgcatccaatttggaaacaggggtcccatcaaggttcagtggaatggttctgggacacattttactttcaccatcagcggcctgcagcctgaagatattgcaacatattactgtcaacagtatggtaatctcccactcactttcggcggagggaccaaggtcgagatcaaacgaactgtggctgcaccatctgtcttcat

SEQ ID NO: 559313 - DNA, 508 bp, Homo sapiens; identical to SEQ ID NO: 535835
  misc_feature: HIJSMM301BB1SA.8.34.D01.1.454.light.4.raw

SEQ ID NO: 559314 - DNA, 444 bp, Homo sapiens; identical to SEQ ID NO: 535411
  misc_feature: HIJSMM301A5PV3.8.73.G07.1.454.light.4.raw

SEQ ID NO: 559315 - DNA, 507 bp, Homo sapiens
  misc_feature: HIJSMM301B3LK1.47.55.E11.1.454.light.4.raw
agctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctaggtcagcccaaggccaacccc

SEQ ID NO: 559316 - DNA, 489 bp, Homo sapiens; identical to SEQ ID NO: 535139
  misc_feature: HIJSMM301ARPRA.14.55.E11.1.454.light.4.raw

SEQ ID NO: 559317 - DNA, 441 bp, Homo sapiens; identical to SEQ ID NO: 546257
  misc_feature: HIJSMM301BNNLG.41.9.A09.1.454.light.4.raw

SEQ ID NO: 559318 - DNA, 484 bp, Homo sapiens
  misc_feature: HIJSMM301EX0WX.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccgacggacccgtcgtgcagtgagcgaggagagtgaggaggagaggagaccaggcatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggttttggctgttcggacggcgggac

SEQ ID NO: 559319 - DNA, 520 bp, Homo sapiens; identical to SEQ ID NO: 535686
  misc_feature: HIJSMM301DM25J.41.19.B08.1.454.light.4.raw

SEQ ID NO: 559320 - DNA, 510 bp, Homo sapiens
  misc_feature: HIJSMM301D0H1W.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctggtcacttctgttccca

SEQ ID NO: 559321 - DNA, 486 bp, Homo sapiens
  misc_feature: HIJSMM301DSGD7.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttatattgtcaacaatattattatactttcgtggacgttcggccaagggaccaaggtggatatcagacgaa

SEQ ID NO: 559322 - DNA, 475 bp, Homo sapiens; identical to SEQ ID NO: 536205
  misc_feature: HIJSMM301C8J1G.48.49.E05.1.454.light.4.raw

SEQ ID NO: 559323 - DNA, 489 bp, Homo sapiens
  misc_feature: HIJSMM301AMBOS.41.2.A02.1.454.light.4.raw
tctatactatcacgaccggtgctcgatttagactcatctacagggggagtcagtcccaaccaggacacagcatggacatgagggtccctgctcagctcctggggctcctgctgctctggctctcaggcgccagatgtgacatccagatgacccagtctccatcctccctgtctgcatctttaggagacagagtcaccatctcttgtcaggcgaatgaggacattaacgtttatttaaattggtatcggcagagaccagggaaagcccctgagctcctgatttatgataaatcgaatttgaatccaggggtcccatctaggttccgtggaagtggatctgggacagactttactctcaccattagcagcctggagcctgaagatattgcaacatattactgttcaacagtctcatggtctcccccttagtttcggcggagggaccaaggttgagatcaaacgaactgtggctgcaccatctgtcttcatt

SEQ ID NO: 559324 - DNA, 485 bp, Homo sapiens; identical to SEQ ID NO: 536576
  misc_feature: HIJSMM301EFZIE.46.35.D02.1.454.light.4.raw

SEQ ID NO: 559325 - DNA, 475 bp, Homo sapiens; identical to SEQ ID NO: 550613
  misc_feature: HIJSMM301BLJ1C.43.76.G10.1.454.light.4.raw

SEQ ID NO: 559326 - DNA, 496 bp, Homo sapiens; identical to SEQ ID NO: 535109
  misc_feature: HIJSMM301BCVWQ.16.78.H01.1.454.light.4.raw

SEQ ID NO: 559327 - DNA, 484 bp, Homo sapiens
  misc_feature: HIJSMM301ADDTG.51.41.D08.1.454.light.4.raw
cgatcgtatacacgaccggtgctcgatttagtcacgcgagaaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaaactcctgatctatgctgcatccagtttgcaaagtgaggtcccatccaggttcagtggcagtggatctgggacagatttcactctcaccatcagtagtctgcaacctgaagattttgcaacttactactgtcaacagagttacggtaccctgctcacttcggcggagggaccaaggtaggagatcaaacgaactgtggctgcaccta

SEQ ID NO: 559328 - DNA, 490 bp, Homo sapiens
  misc_feature: HIJSMM301CRO1D.26.23.C01.1.454.light.4.raw
  modified_base (429)..(429): a, c, t, g, unknown or other
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaataatgatatttattntccagcgttcggccaggggaccaaggtggaagtcaagcgaactgtggctgcaccatctgtt

SEQ ID NO: 559329 - DNA, 503 bp, Homo sapiens
  misc_feature: HIJSMM301AOY14.41.34.D01.1.454.light.4.raw
tctatactatcacgaccggtgctcgatttagatcgtctgtgttgggtttgggggctttgcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggagggaccaaggctgaccgtcctaggtcagcccaaggctgccccctcggtcactctgttcccaccctcctcatagtatacg

SEQ ID NO: 559330 - DNA, 506 bp, Homo sapiens; identical to SEQ ID NO: 537290
  misc_feature: HIJSMM301E2JJ7.13.11.A11.1.454.light.4.raw

SEQ ID NO: 559331 - DNA, 488 bp, Homo sapiens
  misc_feature: HIJSMM301CWF8X.47.36.D03.1.454.light.4.raw
agctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacttgtcgggcgagtcagggtattagcaactggttagcctggtatcaacagaaaccagggaaagcccctaacctcctcatctctactgcatccactttgcaaagtggggtcccatcaaggttcagcggcagtggatctgggacagatttcactctcactatcagcagcctgcagcctgaagattttggaacttattattgtcaacagggtaacagtttcccgctcaccttcggcgagggaccaaggtggagatgaaaagaactgtggctgcaccat

SEQ ID NO: 559332 - DNA, 493 bp, Homo sapiens
  misc_feature: HIJSMM301BE3CS.48.73.G07.1.454.light.4.raw
agtatacatacacgaccggtgctcgatttagctctacgctcagggcacgaccggtgctcgatttagagctcacgtattgggtttgggggaagagctgctcagttaggacccagagggaaccatggaaaccccagcgcagcttctcttcctcctgctactctggctcccagataccaccggagcacttgtgttgacgcagtctccaggcaccctgtctttgtctccaggggagagagccaccctctcctgtagggccagtcagagtgttagcggcggctccgtagcctggtaccagcagaaacgtggccaggttcccaggctcctcatctatgatgcatccagcagggccactggcatcccagacaggttcagtggcagtgggtctgggacagacttcactctcaccatcagcagactggagcctgaagattttgcagtgtattactgtcagcagtatggtagctcacctcaactcactttcggcggagggacg

SEQ ID NO: 559333 - DNA, 504 bp, Homo sapiens
  misc_feature: HIJSMM301C709A.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggaggaccaaggtggagatcaaacgaactgtggctgcaccatctgt

SEQ ID NO: 559334 - DNA, 483 bp, Homo sapiens
  misc_feature: HIJSMM301BPW24.48.73.G07.1.454.light.4.raw
agtatacatacacgaccggtgctcgatttagctctacgctcaggggcagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttatttagcctggtttcagcagaaaccagggaaagcccctaaactcctgatctacgctgcatccactttgcacagtggggtcccgtctaggttcagcggcagcggatctgggacagatttcactctcaccatcagcagcctgcagcctgaagatgttgcaacttattactgtcaacagcttagtagtaaccctccgtacacttttggccaggggaccaaggtggagatcaaacgaactgtggctgcaccatctgtctt

SEQ ID NO: 559335 - DNA, 505 bp, Homo sapiens; identical to SEQ ID NO: 535503
  misc_feature: HIJSMM301B3W7P.8.28.C06.1.454.light.4.raw

SEQ ID NO: 559336 - DNA, 493 bp, Homo sapiens; identical to SEQ ID NO: 535657
  misc_feature: HIJSMM301DN82N.27.78.H01.1.454.light.4.raw

SEQ ID NO: 559337 - DNA, 498 bp, Homo sapiens; identical to SEQ ID NO: 537020
  misc_feature: HIJSMM301ELUXR.26.26.C04.1.454.light.4.raw

SEQ ID NO: 559338 - DNA, 478 bp, Homo sapiens; identical to SEQ ID NO: 535129
  misc_feature: HIJSMM301CDC72.11.11.A11.1.454.light.4.raw

SEQ ID NO: 559339 - DNA, 487 bp, Homo sapiens; identical to SEQ ID NO: 537079
  misc_feature: HIJSMM301EVHVO.14.55.E11.1.454.light.4.raw

SEQ ID NO: 559340 - DNA, 521 bp, Homo sapiens
  misc_feature: HIJSMM301EZV0X.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcggggtctgggacagacttcattctcaccatcaacagactgcagcctgaagatattgcagtttactactgtcagcagtatgttacgtccccgtggacgttcggccaagggaccaaggtggcaatcaaccgaactgtggctgcaccatctgtcttctatctttccccg

SEQ ID NO: 559341 - DNA, 509 bp, Homo sapiens
  misc_feature: HIJSMM301CJ0G9.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggccgtccgggggccactttcggccctcgggaccaaggtggagatcaaacgaactgtggctgcacatctgtcttcatctcccg

SEQ ID NO: 559342 - DNA, 517 bp, Homo sapiens
  misc_feature: HIJSMM301ANNTW.47.23.C01.1.454.light.4.raw
agctcacgtacacgaccggtgctcgatttagtacacgtgattagggattggggctgggcctaaggaagcagcactggtggtgcctcagccatggcctggaccgttctcctcctcggcctcctctctcactgcacagactctgtggcctcctatgtactgactcagccatcctcggtggcagtggccccaggacagacggccaggattccctgtggaggaaacaacattggaagtaagagtgtacattggtaccaacagaggccaggccaggcccctgtgctggtcgtccatgatgatagcgaccggccctcagggatccctgagcgcttctctggctccaattctgggaacacggccaccctgaccatcagcgcggtcgaagcccggagatgaggccgactattactgtcaggtgtgggacagtaatagtgatcccgagcaggttttcggcggtgggaccaagctgaccggtcctaagtcagcccaaggctcgccccctcggtcactctgttccccg

SEQ ID NO: 559343 - DNA, 511 bp, Homo sapiens
  misc_feature: HIJSMM301DPRYL.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaaccccactgtcactctgttccctaa

SEQ ID NO: 559344 - DNA, 495 bp, Homo sapiens; identical to SEQ ID NO: 535596
  misc_feature: HIJSMM301BTIM0.10.79.H02.1.454.light.4.raw

SEQ ID NO: 559345 - DNA, 499 bp, Homo sapiens; identical to SEQ ID NO: 551769
  misc_feature: HIJSMM301AOPDO.43.34.D01.1.454.light.4.raw

SEQ ID NO: 559346 - DNA, 488 bp, Homo sapiens
  misc_feature: HIJSMM301BUHPU.51.53.E09.1.454.light.4.raw
cgatcgtatacacgaccggtgctcgatttagagagagtgtgttgggtttgggggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaagcccccaaactcatgatttatgatgtcagtgatcggccctcaggggtttcgaatcgcttctctggctccaagtccggcaacacggcctccctgaccatctctggcctccaggccgaggacgaggctgattattactgcagctcatatacaatcaataacaattgggtgttcggcggagggaccaaactgaccgtcctaggtcagcccaaggctgccccctcggtcactctgttcccgccctcctctcgtagcact

SEQ ID NO: 559347 - DNA, 486 bp, Homo sapiens; identical to SEQ ID NO: 537238
  misc_feature: HIJSMM301C4P14.19.71.G05.1.454.light.4.raw

SEQ ID NO: 559348 - DNA, 513 bp, Homo sapiens
  misc_feature: HIJSMM301AGFZV.15.34.D01.1.454.light.4.raw
tctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaagctgccctcaccatcacgggggcccaggcagacgatgaatgtgattatcactgcgtcctttatgtggggcgtggcatttgggtgttcggcggagggaccaaactgaccgtcctaggtcagcccaaggctgccccctggtcactctcg

SEQ ID NO: 559349 - DNA, 492 bp, Homo sapiens
  misc_feature: HIJSMM301DPVEZ.13.42.D09.1.454.light.4.raw
tcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctcggacgttcggccaggaccgaaggtggaaatcaaacgaactagtggcgtgcaccactctgt

SEQ ID NO: 559350 - DNA, 523 bp, Homo sapiens; identical to SEQ ID NO: 556310
  misc_feature: HIJSMM301B1OXZ.5.27.C05.1.454.light.4.raw

SEQ ID NO: 559351 - DNA, 505 bp, Homo sapiens
  misc_feature: HIJSMM301C3LTJ.9.52.E08.1.454.light.4.raw
tgatacgtctcacgaccggtgctcgatttagtcgagctctcagagagaaagggggaggaactgctcagttaggacccagagggaaccatggaagccccagcccagcttctcttcctcctgctactctggctcccagaaacgccggagaaattgtgttggcacagtctccagccaccctgtctatgtctccaggggaaagagccaccctctcctgcagggccagtcagagtgttggtacgtccttactctggtaccaacaaaacctggccaggctcccaggctcctcatctatgatgcatccaccagggccactggcatccccgccagattcagtggcagtgggtctgggacagacttcactctcaccatcagcagcctggaccctgaagattttgcagtttattactgtcagcagcggaccaattggccctctccctcactttcggcgggggaccgaaggtggagctcaacgaactgtgctgcaccatctgtcttcatcttcccg

SEQ ID NO: 559352 - DNA, 502 bp, Homo sapiens; identical to SEQ ID NO: 544762
  misc_feature: HIJSMM301A57QN.48.70.G04.1.454.light.4.raw

SEQ ID NO: 559353 - DNA, 494 bp, Homo sapiens; identical to SEQ ID NO: 534992
  misc_feature: HIJSMM301BSPZS.9.1.A01.1.454.light.4.raw

SEQ ID NO: 559354 - DNA, 497 bp, Homo sapiens; identical to SEQ ID NO: 543330
  misc_feature: HIJSMM301EQWL0.9.39.D06.1.454.light.4.raw

SEQ ID NO: 559355 - DNA, 492 bp, Homo sapiens; identical to SEQ ID NO: 536010
  misc_feature: HIJSMM301EHMMT.10.20.B09.1.454.light.4.raw

SEQ ID NO: 559356 - DNA, 502 bp, Homo sapiens
  misc_feature: HIJSMM301AI69A.48.26.C04.1.454.light.4.raw
agtatacatacacgaccggtgctcgatttagtctagcgactttgggtttggggtggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaagctgaccgtcctaggtcagcccaaggctgccccctc

SEQ ID NO: 559357 - DNA, 486 bp, Homo sapiens; identical to SEQ ID NO: 535917
  misc_feature: HIJSMM301B50W1.3.10.A10.1.454.light.4.raw

SEQ ID NO: 559358 - DNA, 444 bp, Homo sapiens; identical to SEQ ID NO: 544367
  misc_feature: HIJSMM301BVTHI.2.76.G10.1.454.light.4.raw

SEQ ID NO: 559359 - DNA, 503 bp, Homo sapiens; identical to SEQ ID NO: 538884
  misc_feature: HIJSMM301CSHL2.27.78.H01.1.454.light.4.raw

SEQ ID NO: 559360 - DNA, 484 bp, Homo sapiens; identical to SEQ ID NO: 535240
  misc_feature: HIJSMM301CK31D.47.60.F05.1.454.light.4.raw

SEQ ID NO: 559361 - DNA, 484 bp, Homo sapiens; identical to SEQ ID NO: 535240
  misc_feature: HIJSMM301BG3B4.47.60.F05.1.454.light.4.raw

SEQ ID NO: 559362 - DNA, 485 bp, Homo sapiens
  misc_feature: HIJSMM301C13J3.12.33.C11.1.454.light.4.raw
atacgacgtacacgaccggtgctcgatttagagtgagctcgttgggtttgggggcaggagtcagtctcagtcaggacacagcatggacatgagggtccccgctcagctcctggggctcctgctactctggctccgaggtgccagatgtgacatccagatgacccagtctccttcctccctgtctgcatctgtcggagacagcgtcaccatcacttgtcgggcaagtcagaacatttacaattatttaaattggtatcagcagaaaccagggaaagcccctaaatcctgatctatcatgaatccagtttgcgaagtggagtcccatcaaggttcagtggcactgggtctgagacagagttcactctcaccatcagcactctacagcctgaagattttgcaacttattattgtcaacaaagttatgagacccctgccactttcggccctgggaccatagtggatatgaaacgaactgtggctgcacc

SEQ ID NO: 559363 - DNA, 478 bp, Homo sapiens
  misc_feature: HIJSMM301B07ZW.10.74.G08.1.454.light.4.raw
catagtagtgcacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaggagccaccctctcctgcagggccagtcagagtattagcagcaacttagcctggtaccagcagaaacctggccagtctcccaggctcctcctctatgatgcatccaccagggccactggtatcccagccaggttcagtggcagtgggtctgggacagagttcactctcaccatcagcagcctgcagtctgaggatattgcagtttattactgtcagcagtatactaactggcctctgacgttcggccaagggaccagggtggaaatcaaacgaactgtggctgcacat

SEQ ID NO: 559364 - DNA, 490 bp, Homo sapiens; identical to SEQ ID NO: 541244
  misc_feature: HIJSMM301BFSWF.41.44.D11.1.454.light.4.raw

SEQ ID NO: 559365 - DNA, 489 bp, Homo sapiens; identical to SEQ ID NO: 549527
  misc_feature: HIJSMM301C1I8R.15.49.E05.1.454.light.4.raw

SEQ ID NO: 559366 - DNA, 506 bp, Homo sapiens
  misc_feature: HIJSMM301AQQ2L.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgattcgcttctctgcctccaaggctggcaacacggcctccctgaccgtctctgggctccaggctgaggatgaggctgattattattgcagctcatatgcaggcagttacaatgtgatattcggcggagggaccaaactgaccgtcctaggtcagccccaaggctcgcccccttc

SEQ ID NO: 559367 - DNA, 500 bp, Homo sapiens
  misc_feature: HIJSMM301CR4HC.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccaccggagaaattgtgttgacgcagtctccaggcaccctgtctttgtctccaggggaaagagccaccctctcctgcagggccagtcagagtgttaccagcaggtacttagcctggtaccagcagaaacctggcctggctcccaggctcctcatctatggtgcatccagcagggccactggcatcccagacaggttcagtggcagtgggtctgggacagacttcactctcaccctcagcagactggagcctgaagattttgcagtgtattactgtcagcagtatggtagggcaccttacacttttggccaggggaccaagctggagatcaaacgaactgtggctgcaccatctgtcttcatt

SEQ ID NO: 559368 - DNA, 482 bp, Homo sapiens
  misc_feature: HIJSMM301ETUXI.41.68.G02.1.454.light.4.raw
tctatactatcacgaccggtgctcgatttagtcgatagtgaagggaaagggggagtcagtcccaaccaggacacagcatggacatgagggtccctgctcagctcctggggctcctgctgctctggctctcaggtgccagatgtgacatccagatgacccagtctccaacctccctgtctgcatctgtaggagacagagtcaccatcacttgccaggccagtcaggacattagcaactatttaaattggtatcagcagaaaccagggaaagcccctaagctcctgatctacgatgcacccaatttggaatcagggtcccatcaaggttcagtggaagtggatctgggacagattttactttcaccatcaccagcctgcagcctgaagatattgcaacatattactgtcaacagtatgataatctccctcccactttcggcggagggaccaaggtggagatcaaacgaactgtggctgcaccat

SEQ ID NO: 559369 - DNA, 496 bp, Homo sapiens; identical to SEQ ID NO: 535612
  misc_feature: HIJSMM301API9H.22.9.A09.1.454.light.4.raw

SEQ ID NO: 559370 - DNA, 484 bp, Homo sapiens; identical to SEQ ID NO: 535240
  misc_feature: HIJSMM301EHRI1.47.60.F05.1.454.light.4.raw

SEQ ID NO: 559371 - DNA, 482 bp, Homo sapiens
  misc_feature: HIJSMM301AYS9H.51.34.D01.1.454.light.4.raw
cgatcgtatacacgaccggtgctcgatttagatcgtctgtgttgggtttgggagggggtcaggctggaactgaggagcaggtgggggcacttctccctctaacactcttccctgctcagctcctgggactcctgctgctctggctcccagataccagatgtgacatccagatgacccagtctccatcctccctgtctgcatctataggagacagagtcaccatcacttgccgggcgagtcagggcgtcagcatttatttggcctggtatcagcagagaccagggaaagctcctaaactcctgatctatgaggcatccactttacaatcaggggtcccatctcgtttcagtggcagtggatctggggcacatttcactctcaccatcagcagcctgcagcctgacgatgttgcaacttattactgtcaaaattataacagggccgttgcgctcactttcggcgggggaccgaaggtggagatc

SEQ ID NO: 559372 - DNA, 489 bp, Homo sapiens; identical to SEQ ID NO: 535139
  misc_feature: HIJSMM301AMHVG.14.55.E11.1.454.light.4.raw

SEQ ID NO: 559373 - DNA, 508 bp, Homo sapiens; identical to SEQ ID NO: 540640
  misc_feature: HIJSMM301DQW3R.5.60.F05.1.454.light.4.raw

SEQ ID NO: 559374 - DNA, 508 bp, Homo sapiens; identical to SEQ ID NO: 547873
  misc_feature: HIJSMM301BQJF2.47.83.H06.1.454.light.4.raw

SEQ ID NO: 559375 - DNA, 526 bp, Homo sapiens
  misc_feature: HIJSMM301A8QVL.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgttcgtcgacgggaccgacgacgtagaaagtagtaaggacgaacgtagtggtcgtcgcgaccaactactcgtcttcctatcttcccgtcccc

SEQ ID NO: 559376 - DNA, 509 bp, Homo sapiens; identical to SEQ ID NO: 547302
  misc_feature: HIJSMM301A0RYS.4.57.F02.1.454.light.4.raw

SEQ ID NO: 559377 - DNA, 510 bp, Homo sapiens
  misc_feature: HIJSMM301C3VR6.43.59.F04.1.454.light.4.raw
tgtgagtagtcacgaccggtgctcgatttagtacacacacttagggattggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaagcccccaaactcttgatttatgatgtcacttatcggccctcaggggtttcttatcgcttctctggctccaagtctggcaacacggcctccctgaccatctctgggctccaggctgaggacgaggctgattattactgcaactcacttacaacgaccgacacttgcgtattcggcggcgggaccaagctgaccgtcctaggtcagcccaaggctgccccctcggtcact

SEQ ID NO: 559378 - DNA, 496 bp, Homo sapiens; identical to SEQ ID NO: 535109
  misc_feature: HIJSMM301D036J.16.78.H01.1.454.light.4.raw

SEQ ID NO: 559379 - DNA, 497 bp, Homo sapiens; identical to SEQ ID NO: 535286
  misc_feature: HIJSMM301C22S7.18.59.F04.1.454.light.4.raw

SEQ ID NO: 559380 - DNA, 493 bp, Homo sapiens
  misc_feature: HIJSMM301BGVT1.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccggtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccagggtggagatcagacgaactgtggctgcaccatctgtctt

SEQ ID NO: 559381 - DNA, 489 bp, Homo sapiens; identical to SEQ ID NO: 535139
  misc_feature: HIJSMM301B87DS.14.55.E11.1.454.light.4.raw

SEQ ID NO: 559382 - DNA, 490 bp, Homo sapiens
  misc_feature: HIJSMM301EDFQZ.13.87.H10.1.454.light.4.raw
tcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagcaaaaaccagggaaagtccctaagctcctgatctatgttgcatccactttgcaaagtggggtcccatcaaggttcagcggcagtggatctgggacagaattcactctcaccatcaccagtctgcaacctgaagactgtgcaacttactactgccaacagtcttacggaacctcgtacacttttggccaggggaccaggctggagatcaaacgaactgtggctgcaccatctgtcttcatt

SEQ ID NO: 559383 - DNA, 444 bp, Homo sapiens
  misc_feature: HIJSMM301AR18E.17.21.B10.1.454.light.4.raw
cgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaatcagcagggtggaggctgaggatgtcggggtttactactgcatgcagggtacactctggccgttcacttttggccaggggaccaaaactggatatcagacgaactgtggctgcaccatctgtcttcatcttcccgccatctgactagtctacg

SEQ ID NO: 559384 - DNA, 483 bp, Homo sapiens
  misc_feature: HIJSMM301DIC7N.3.40.D07.1.454.light.4.raw
agacgcactccacgaccggtgctcgatttagtgatagagcgtaacaacagaggggagactcagtcaggacacagcatggacatgagggtccccgctcagctcctggggctcctgctgctctggctcccaggtgccagatgtgacatccagatgacccagtctccttccaccctgtctgcctctataggagacagagtcaccatcacttgcggggccagtcagagtataagtaatttgttggcctggtatcagcagaaaccaggcaaagccccaaagctccttatttctgatgcctccactttgcacgttggggtcccaccaacgttcagcggcagtggatctgggacagatttcactctcaccatcagcagcctgcagcctgatgatgttgcaacttattactgtcaacaatataacacttattggacgttcggccaggggaccaaggtggaaatcaaacgaactgtggctgcaccatctgtt

SEQ ID NO: 559385 - DNA, 496 bp, Homo sapiens
  misc_feature: HIJSMM301BEV2V.16.46.E02.1.454.light.4.raw
tgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaaccccactgtcactctgttcccacctcctcgagtagtaca

SEQ ID NO: 559386 - DNA, 498 bp, Homo sapiens
  misc_feature: HIJSMM301DIGBM.3.33.C11.1.454.light.4.raw
agacgcactccacgaccggtgctcgatttagagtgagctcgttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgtccccccg

SEQ ID NO: 559387 - DNA, 496 bp, Homo sapiens
  misc_feature: HIJSMM301AZ3BM.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccctcggtcactctgttcccgccttcctcgagtgcgtct

SEQ ID NO: 559388 - DNA, 510 bp, Homo sapiens; identical to SEQ ID NO: 541797
  misc_feature: HIJSMM301EXFIV.15.34.D01.1.454.light.4.raw

SEQ ID NO: 559389 - DNA, 457 bp, Homo sapiens
  misc_feature: HIJSMM301D1N8J.18.78.H01.1.454.light.4.raw
tacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaaccccactgtcactctgttcccgccctcctccatactcgta

SEQ ID NO: 559390 - DNA, 485 bp, Homo sapiens; identical to SEQ ID NO: 535985
  misc_feature: HIJSMM301AR32L.15.1.A01.1.454.light.4.raw

SEQ ID NO: 559391 - DNA, 512 bp, Homo sapiens
  misc_feature: HIJSMM301DGTD3.7.34.D01.1.454.light.4.raw
cgtgtctctacacgaccggtgctcgatttagatcgtctgtgttgggtttgggggggtcgtcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggactccagactgaggacgaggctgattattactgctgctcatatacaggggacagcattatttgggtgttcggcggagggaccaagctgaccgtcctgcgtcagcccaaggctgccccctcggtcactc

SEQ ID NO: 559392 - DNA, 502 bp, Homo sapiens
  misc_feature: HIJSMM301EJH5G.43.34.D01.1.454.light.4.raw
tgtgagtagtcacgaccggtgctcgatttagatcgtctgtgttgggtttgggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaacgcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcgggaattggggacgacggtcaccgtcctaggtcagcccaaggcccaaccca

SEQ ID NO: 559393 - DNA, 500 bp, Homo sapiens
  misc_feature: HIJSMM301AGKAN.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttattttttacagctccaccaataagagttacttagcttggttccagcagaaaccaggacatcgtcctgcactgctcatttactgggcgtctacccgggaatccggggtccctgaccgattcagtggcaggcgggtctgggacagatttcactctcaccatcagcagcctgcaggctgaagatgtggcagtttattattgtcagcaatattatattcctcctcagacgttcggccaagggaccaaggtaggaaatacaaacgaactgtggctgcacc

SEQ ID NO: 559394 - DNA, 505 bp, Homo sapiens
  misc_feature: HIJSMM301EJF6O.48.71.G05.1.454.light.4.raw
agtatacatacacgaccggtgctcgatttagtgtcgtcgcaagagagaggggagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccaggctcctcatctatggtgcgtccaccagggccactggcatcccagacaggttcagtggcagtgggtctgggacagacttcactctcaccatcaccagactggagcctgatgattttgcagtgttttctgttcagcagtatggaagttcacctcggacattcggccaggggaccaaggtggaaatcaaacgaactgtttggctgcaccatctgtcttcatcttcccg

SEQ ID NO: 559395 - DNA, 484 bp, Homo sapiens
  misc_feature: HIJSMM301CFCCU.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcaccgtctaggtcagcccaaggccaaccc

SEQ ID NO: 559396 - DNA, 501 bp, Homo sapiens
  misc_feature: HIJSMM301AV8W5.15.67.G01.1.454.light.4.raw
tctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagatttcactctcaccatcagcagcctgcagcctgaagatttcgcaacttattactgtctacaagattacaattaccctcggacgttcggtccacggggaccgaacggtaggaaagtactaaacgaaacctagtggcgtggcaccaa

SEQ ID NO: 559397 - DNA, 454 bp, Homo sapiens; identical to SEQ ID NO: 534964
  misc_feature: HIJSMM301CJM79.19.86.H09.1.454.light.4.raw

SEQ ID NO: 559398 - DNA, 508 bp, Homo sapiens
  misc_feature: HIJSMM301DODEV.49.65.F10.1.454.light.4.raw
agtcgagagacacgaccggtgctcgatttagctacgctctaaggggctgggcctaaggaagcagcactggtggtgcctcagccatggcctggaccgttctcctcctcggcctcctctctcactgcacagtctctgtgacctcctatgtgctgtctcagtcaccctcggtgtcagtggccccaggacagacggccaggattacctgtgggggagacaacattggaaataaaggtgtgcactggtaccagcagatgccaggccaggcccctgtcctggtcgtctttgatgatagcgaccggccctcagggatccctgagcgattctctggctccaactctggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctcggtccactctgttcccaccct

SEQ ID NO: 559399 - DNA, 496 bp, Homo sapiens
  misc_feature: HIJSMM301AOZ0S.4.24.C02.1.454.light.4.raw
agcactgtagcacgaccggtgctcgatttagtacagatcgttagggaaagggggagtcagactcagtcaggacacagcatggacatgagggtccccgctcagctcctggggctcctgctgctctggctcccaggtgccaaatgtgacgtccagatgacccagtctccttccaccctgtctgcatctataggagacagagtcaccatcacttgccgggccagtcagagtattagtaactggttggcctggtatcagcagaaaccaggcaaagccccaaaactccttatctctgatgcctccactttgcacggtggggtcccaccaacgttcagcggcagtgggtctgggacagaattcactctcaccatcagcagcctgcaacctgatgatgttgcaacttattactgtcaacaatataactagttattggacgttcggccgaagggaccgaaggtaggaaatacagacgaactgtggctgcaccatctgtcttcta

SEQ ID NO: 559400 - DNA, 490 bp, Homo sapiens; identical to SEQ ID NO: 535936
  misc_feature: HIJSMM301CD651.16.68.G02.1.454.light.4.raw

SEQ ID NO: 559401 - DNA, 493 bp, Homo sapiens; identical to SEQ ID NO: 535047
  misc_feature: HIJSMM301CKNOG.16.53.E09.1.454.light.4.raw

SEQ ID NO: 559402 - DNA, 440 bp, Homo sapiens; identical to SEQ ID NO: 547410
  misc_feature: HIJSMM301CRL30.11.3.A03.1.454.light.4.raw

SEQ ID NO: 559403 - DNA, 517 bp, Homo sapiens; identical to SEQ ID NO: 539607
  misc_feature: HIJSMM301BND32.41.55.E11.1.454.light.4.raw

SEQ ID NO: 559404 - DNA, 487 bp, Homo sapiens; identical to SEQ ID NO: 548447
  misc_feature: HIJSMM301C4CAL.10.23.C01.1.454.light.4.raw

SEQ ID NO: 559405 - DNA, 479 bp, Homo sapiens; identical to SEQ ID NO: 535586
  misc_feature: HIJSMM301AE8LR.13.34.D01.1.454.light.4.raw

SEQ ID NO: 559406 - DNA, 496 bp, Homo sapiens
  misc_feature: HIJSMM301A12LU.51.39.D06.1.454.light.4.raw
cgatcgtatacacgaccggtgctcgatttagtgacatctcgcagttctttgggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccaacagaagccaggccaggcccctgtgttgttgatatataaagacagtgagaggccttcagggatccctgagcgattctctggctccacctcagggacactggtcacattgaccatcagtggagtccaggcagaagacgaggctgactatttctgtcaatcttcagacgtcagtggtacttatgtcttcggaactgggaccaaggtcaccgtcctaggtcagcccaaggccaacccactgtcact

SEQ ID NO: 559407 - DNA, 498 bp, Homo sapiens
  misc_feature: HIJSMM301AT7T2.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagctgaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccaaggaccaaggtggaaatcaaacgaaactgtggctgcacc

SEQ ID NO: 559408 - DNA, 504 bp, Homo sapiens; identical to SEQ ID NO: 536385
  misc_feature: HIJSMM301AIT7S.27.78.H01.1.454.light.4.raw

SEQ ID NO: 559409 - DNA, 494 bp, Homo sapiens
  misc_feature: HIJSMM301B9GR4.51.29.C07.1.454.light.4.raw
cgatcgtatacacgaccggtgctcgatttagagtgctacgaagggaaagggggaggaactgctcagtcaggacccagacggaaccatggaagccccagcgcagcttctcttcctcctgctactctggctcccagatactactggagaaatagtgatgacgcagtctccagccacgctgtctgtgtctccaggggaaagagccaccctctcctgcagggccagtcagagtgttaacaacaacttagcctggtatcagcagaaacctggccaggctcccaggctcctcatctttggatcatccatcagggccactggtgtcccagaaaagttcagtggcggtgggtctgacacagagtacaccctcaccatcagcaccctgcagtctgaagatgtcgcagtttattactgtcaacaatatagtgacaggccgccatggacgttcggccaaggaccaaggtggaaatgaaaggaactgtggctgcaccatctgtctt

SEQ ID NO: 559410 - DNA, 499 bp, Homo sapiens; identical to SEQ ID NO: 540144
  misc_feature: HIJSMM301CGV29.47.66.F11.1.454.light.4.raw

SEQ ID NO: 559411 - DNA, 501 bp, Homo sapiens
  misc_feature: HIJSMM301CYA1K.48.61.F06.1.454.light.4.raw
agtatacatacacgaccggtgctcgatttagctacgctctaagggaaagggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcctcgggcgttcggccaagggaccgaacggtggaaagtacaaacgaactagtcggctgcacc

SEQ ID NO: 559412 - DNA, 494 bp, Homo sapiens; identical to SEQ ID NO: 534994
  misc_feature: HIJSMM301B43DV.27.78.H01.1.454.light.4.raw

SEQ ID NO: 559413 - DNA, 515 bp, Homo sapiens; identical to SEQ ID NO: 536247
  misc_feature: HIJSMM301ECHSV.14.19.B08.1.454.light.4.raw

SEQ ID NO: 559414 - DNA, 515 bp, Homo sapiens
  misc_feature: HIJSMM301A6B7H.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgtcacggacgaaggtaggagtacgaacgaactagtggcgtgcaccactctgtcttctatcttcccgtcccactctgact

SEQ ID NO: 559415 - DNA, 490 bp, Homo sapiens; identical to SEQ ID NO: 546232
  misc_feature: HIJSMM301AKHT5.51.28.C06.1.454.light.4.raw

SEQ ID NO: 559416 - DNA, 509 bp, Homo sapiens; identical to SEQ ID NO: 539359
  misc_feature: HIJSMM301BLA9H.47.85.H08.1.454.light.4.raw

SEQ ID NO: 559417 - DNA, 495 bp, Homo sapiens
  misc_feature: HIJSMM301BC0K9.26.12.B01.1.454.light.4.raw
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtatcccggccagattcagtggcagggggtctgggacagaattcactctcaccatcaccagcctgcagtctgaagattttgcagtctattactgtcagcaatataattactggctctctttcggcggggggaccaagctggagatcaaccgaactgtggctgcaccatctgtt

SEQ ID NO: 559418 - DNA, 486 bp, Homo sapiens; identical to SEQ ID NO: 540808
  misc_feature: HIJSMM301CVLHU.26.70.G04.1.454.light.4.raw

SEQ ID NO: 559419 - DNA, 502 bp, Homo sapiens; identical to SEQ ID NO: 541971
  misc_feature: HIJSMM301A5EM8.4.39.D06.1.454.light.4.raw

SEQ ID NO: 559420 - DNA, 504 bp, Homo sapiens; identical to SEQ ID NO: 538681
  misc_feature: HIJSMM301DGFOS.7.71.G05.1.454.light.4.raw

SEQ ID NO: 559421 - DNA, 482 bp, Homo sapiens
  misc_feature: HIJSMM301COCVE.48.22.B11.1.454.light.4.raw
agtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttatttagcctggtttcagcagaaaccagggaaagcccctaaactcctgatctacgctgcatccactttgcacagtgggtcccgtctaggttcagcggcagcggatctgggacagatttcactctcaccatcagcagcctgcagcctgaagatgttgcaacttattactgtcaacagcttagtagtaaccctccgtacacttttggccaggggaccaaggtggagatcaaacgaactgtggctgcaccatctgtctt

SEQ ID NO: 559422 - DNA, 484 bp, Homo sapiens
  misc_feature: HIJSMM301DP2NT.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagccaaggctgccccctcggtcactctgttcccgccctcctcgctacgtaga

SEQ ID NO: 559423 - DNA, 444 bp, Homo sapiens; identical to SEQ ID NO: 534993
  misc_feature: HIJSMM301EWIOW.5.9.A09.1.454.light.4.raw

SEQ ID NO: 559424 - DNA, 492 bp, Homo sapiens
  misc_feature: HIJSMM301CQLCJ.13.5.A05.1.454.light.4.raw
tcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagttactcctccgaggctcactttcggcggagggaccaaggtggagatcaaacgaactgtgg

SEQ ID NO: 559425 - DNA, 495 bp, Homo sapiens; identical to SEQ ID NO: 553683
  misc_feature: HIJSMM301ATGMV.48.1.A01.1.454.light.4.raw

SEQ ID NO: 559426 - DNA, 506 bp, Homo sapiens
  misc_feature: HIJSMM301CSM7A.43.3.A03.1.454.light.4.raw
tgtgagtagtcacgaccggtgctcgatttagagagcgtcacagggggtagctcaggaagcagagcctggagcatctccactatggcctgggctccactacttctcaccctcctcgctcactgcacaggttcttgggccagttttatgctgactcagccccactctgtgtcggagtctccggggaagacggtaaccatctcctgcacccgcagcggtggctttattgccagcaataatatgcagtggtaccagcagcgcccgggcagtcccccaccactgtgatctatgaggatgaccaaagaccctctggggtccctaatcggttctctggctccgtcgacacctcctccaactctgcctacctcaccatctctggactgaagactgaggacgaggctgactattactgtcactcttatgatcgcaacaacagggtgttcggcggagggaccaggttgaccgtccttggtcagcccaaggctgccccctcggtcactctgttccca

SEQ ID NO: 559427 - DNA, 485 bp, Homo sapiens
  misc_feature: HIJSMM301D8BMM.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagatttgcaacttactactgtcaacagagttacgtacccgtacacttttggccagggaccaaactggacatacaaacgaactgtggctgcaccatctgtt

SEQ ID NO: 559428 - DNA, 508 bp, Homo sapiens; identical to SEQ ID NO: 541988
  misc_feature: HIJSMM301D9W3T.5.60.F05.1.454.light.4.raw

SEQ ID NO: 559429 - DNA, 491 bp, Homo sapiens; identical to SEQ ID NO: 536211
  misc_feature: HIJSMM301DJ0L6.16.53.E09.1.454.light.4.raw

SEQ ID NO: 559430 - DNA, 483 bp, Homo sapiens
  misc_feature: HIJSMM301EB4A2.52.4.A04.1.454.light.4.raw
cgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctccccaggacagacagccagcatcagctgttctggagataaaatggaggataaatatgtttcctggtatcgccagaagccaggccagtcgcctgtcctggtcatctatcacgataagaagcggccctcagggatccctgagcgattctctggctccaactctgggaacacagccactctgaccatcagcgggacccaggctatggatgaggctgactattactgtcagccgtgggacagaagcactctggtgttcggcggagggaccaggctgaccgtcctaggtcagcccaaggcctgtccccccg

SEQ ID NO: 559431 - DNA, 504 bp, Homo sapiens; identical to SEQ ID NO: 535495
  misc_feature: HIJSMM301BZS5F.14.86.H09.1.454.light.4.raw

SEQ ID NO: 559432 - DNA, 499 bp, Homo sapiens; identical to SEQ ID NO: 549770
  misc_feature: HIJSMM301AYZ3R.22.27.C05.1.454.light.4.raw

SEQ ID NO: 559433 - DNA, 495 bp, Homo sapiens; identical to SEQ ID NO: 535596
  misc_feature: HIJSMM301DUFTG.10.79.H02.1.454.light.4.raw

SEQ ID NO: 559434 - DNA, 374 bp, Homo sapiens
  misc_feature: HIJSMM301B0V61.49.45.E01.1.454.light.4.raw
agtcgagagacacgaccggtgctcgatttagtgagtcagtaagggaaagggccaccctctcctgcagggccagtcagagcgttagcaacagttatgtagcctggtaccagcagaaacctggccagtctcccaggctcctcatctatgctgcgtccagcagggccactggcatcccggacaggttcagtggcagtgggtctgggacagacttctctctcaccatcagcagactggagcctgaagattttgcagtatattactgtcagcatgggagcattcgtgcgctcaccttcggcggagggaccaaggtggagatcaaacgaactgtggctgcaccatctgtcttcatcttcccgccatctgatctctcgact

SEQ ID NO: 559435 - DNA, 482 bp, Homo sapiens
  misc_feature: HIJSMM301B8G6I.52.5.A05.1.454.light.4.raw
cgcagtacgacacgaccggtgctcgatttagatagatagacagggggggcctcaggaagcagcatcggaggtgcctcagccatggcatggatccctctcttcctcggcgtccttgcttactgcacaggttctgtggcctcctatgacttgactcagccaccctcagtgtccgtgtccccaggacagacagccaccatcacctgctctggacatcgattgggggatatacatgtttcctggtatcagcagaagccaggccagtctcctgttctcctcatctataagatgtcaagcggccctcagggatccctgagcgattctctggctccaattctggaaatgcagccactctgaccatcagcgggacccagcctatggatgaggctgactattactgtcaggcgtgggacagtaggtttgtgcttttcggcggagggaccaagctgaccgtcctacgtcagcccaaggctgccccctcggtc

SEQ ID NO: 559436 - DNA, 488 bp, Homo sapiens; identical to SEQ ID NO: 536554
  misc_feature: HIJSMM301BIA22.26.37.D04.1.454.light.4.raw

SEQ ID NO: 559437 - DNA, 485 bp, Homo sapiens
  misc_feature: HIJSMM301DKGYU.10.1.A01.1.454.light.4.raw
catagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagctcctctccgacaggaataacatccggccctcagggatctcagagagattctctgcatccaggtcaggaagcacacgcctccctgaccattactggactccaggctgacgacgaagctgattattactgctcagcatgggacaccggcctcagtgcgtgggtttcggcggagggaccaagctgaccgtcctacggtcagacccg

SEQ ID NO: 559438 - DNA, 471 bp, Homo sapiens; identical to SEQ ID NO: 555745
  misc_feature: HIJSMM301DUCTD.18.76.G10.1.454.light.4.raw

SEQ ID NO: 559439 - DNA, 486 bp, Homo sapiens
  misc_feature: HIJSMM301BLD4N.5.23.C01.1.454.light.4.raw
atcagacacgcacgaccggtgctcgatttagtacacgtgattagggattgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtggggtcccatcaaggttcagtggcagtggatctgggacagatttcactctcaccatcagtagtctacaacctgaagattttgcaacttactactgtcaacagagttacgatacccctccgctcactttcggcggaggaccaaggtggagatcaaacgaactgtggctgcaccat

SEQ ID NO: 559440 - DNA, 494 bp, Homo sapiens; identical to SEQ ID NO: 534992
  misc_feature: HIJSMM301EH22B.9.1.A01.1.454.light.4.raw

SEQ ID NO: 559441 - DNA, 504 bp, Homo sapiens; identical to SEQ ID NO: 536385
  misc_feature: HIJSMM301BJPJG.27.78.H01.1.454.light.4.raw

SEQ ID NO: 559442 - DNA, 494 bp, Homo sapiens
  misc_feature: HIJSMM301CTWN0.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctctactttcggcggacggaccgaaggcggagatacagacgaactgtggctgccaccatctgttcttcta

SEQ ID NO: 559443 - DNA, 484 bp, Homo sapiens; identical to SEQ ID NO: 535400
  misc_feature: HIJSMM301E3OD0.46.26.C04.1.454.light.4.raw

SEQ ID NO: 559444 - DNA, 495 bp, Homo sapiens; identical to SEQ ID NO: 541828
  misc_feature: HIJSMM301BXRES.19.71.G05.1.454.light.4.raw

SEQ ID NO: 559445 - DNA, 501 bp, Homo sapiens
  misc_feature: HIJSMM301BU9BF.4.6.A06.1.454.light.4.raw
agcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccggcagagggtcaccatctcttgttctggaagcacctccaacatcggaagtaatcctgtaaactggttccagcaactcccaggaagggcccccaaagtcctcatctatggtcagaatcagcgtccctcaggggtccctgaccgattctctggctccaagtctgacacctcagcctccctggccatcagtgggctccagtctgaggatgaggctgattattactgtgcaacatgggatgacatcctacgtggtgcggtgttcggcggagggaccaagttgaccgtcctgggtcagcccaaggctgccccctc

SEQ ID NO: 559446 - DNA, 509 bp, Homo sapiens; identical to SEQ ID NO: 543741
  misc_feature: HIJSMM301ARL7P.17.33.C11.1.454.light.4.raw

SEQ ID NO: 559447 - DNA, 502 bp, Homo sapiens
  misc_feature: HIJSMM301C4NZR.8.1.A01.1.454.light.4.raw
ctcgcgtgtccacgaccggtgctcgatttagacgtctcatcagggggtgggctcaggaggcagagctctgggaatctcaccatggcctggacccctctcctgctccccctcctcactttctgtacagtctctgaggcctcctatgagctgacacagccaccctcggtgtcagtgtccccaggacaaatggccaggatcacctgctctggagatgaattgccaaagaaatatgcttattggtaccagcagaagtcaggccaggcccctgtcctggtcatttatgaggacaagaaacgaccctccgggatccctgacagactctctggctccagctcagggacagtggccaccttgactatcactggggcccaggtggaggatgaaggagactactattgttactctccagagaaggatggtcatcattgggtgttcggcggagggaccaagctgaccgtcctaagtcagcccaaggctgccccctggtcactctgtcccacct

SEQ ID NO: 559448 - DNA, 503 bp, Homo sapiens
  misc_feature: HIJSMM301A69WF.7.5.A05.1.454.light.4.raw
cgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggtttccgtaatcgcttctctggctccaagtctggcgacacggcctccctgaccactctctgggctccaggctcgaagacgaggctgattattactgcagctcatatacaggcagcagcactcaggttttcggcggagggaccaagctgaccgtccctaggtcagcccaaggctcgccccctccggt

SEQ ID NO: 559449 - DNA, 500 bp, Homo sapiens
  misc_feature: HIJSMM301C6UQL.9.81.H04.1.454.light.4.raw
tgatacgtctcacgaccggtgctcgatttagtagtgtagattcgcgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtgcttataactatgtctcctggtaccaacagcacccaggcaaagtccccaaactcatgatttatgaggtcaataagcggccctctggggtccctgatcgcttctctggctccaagtctggcaacacggcctccctgaccgtctctgggctccaggctgacgatgaggctgattattactgcagctcatatgcaggcacccacaatgtcttcggaagtgggaccacggtcaccgtcctaggtcagcccaaggccaaccccactgtcact

SEQ ID NO: 559450 - DNA, 515 bp, Homo sapiens; identical to SEQ ID NO: 536247
  misc_feature: HIJSMM301ADC5X.14.19.B08.1.454.light.4.raw

SEQ ID NO: 559451 - DNA, 501 bp, Homo sapiens
  misc_feature: HIJSMM301CJ63E.10.68.G02.1.454.light.4.raw
catagtagtgcacgaccggtgctcgattagtcgatagtgaagggaaagggggtgtgggctcaggaggcagagctctgggaatctcaccatggcctggacccctctcctgctccccctcctcactttctgcacagtctctgaggcctcgtatgaactgacacagccaccctcggtgtcagtgtccccaggacagactgccaggatcagctgctctggagatgcattgccaacaaaatatgcttattggtacgagcaaaagccaggccaggcccctgtcttgttgatatatgaggacaccaagcgaccctccggaatttctgagagattctccggctccagctcagggacagtggcctccttgactatcagtggggcccagggggtcgatgaggctgactactactgtttctcgactgacttcactggtaaacgttggctgttcggcggagggaccaagctgaccgtcctgcgtcagcccaacggctcgccccctcggtcact

SEQ ID NO: 559452 - DNA, 483 bp, Homo sapiens
  misc_feature: HIJSMM301B0RMS.40.37.D04.1.454.light.4.raw
tctagcgactcacgaccggtgctcgatttagtagcatactgttgggtttggggataaaagctcagctctaaccttgccttgactgatcaggacttctcagttcatcttctcaccatgaggctccctgctcagctcctggggctgctaatgctctggatccctggttccagtgcgagggttgtgatgactcagactccactctctctgtccgtcacccctggacagccggcctccatctcctgcaagtctgctcagagcctcctgcatggtgatggaatcacctatttatattggtacctgcagaagccaggccagtctccacagctcctaatctatgaggtttccagccggttctctggagtgccagataggttcagtggcagcgggtcagtgacagatttcacactgaaaatcagccgggtggaggctgaggatgttggggtttattactgcatgcaaggtttataccttcctcggactttc

SEQ ID NO: 559453 - DNA, 484 bp, Homo sapiens; identical to SEQ ID NO: 537878
  misc_feature: HIJSMM301EGQ5F.17.34.D01.1.454.light.4.raw

SEQ ID NO: 559454 - DNA, 518 bp, Homo sapiens
  misc_feature: HIJSMM301AHIPK.47.53.E09.1.454.light.4.raw
agctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctctgggatccccgagcgattctctggctccaagtctgggaacacggccaccctgaccgtcagcagggtcgacgtcggggatgaggccgtatatttttgtcaggtgtgggagactaattttggtcatatgttgttcggcggagggaccaagctgaccgtcctcggtcagcccaaggctgccccctcggtcactctgttcccaccctcctc

SEQ ID NO: 559455 - DNA, 480 bp, Homo sapiens; identical to SEQ ID NO: 553480
  misc_feature: HIJSMM301DA3XE.21.25.C03.1.454.light.4.raw

SEQ ID NO: 559456 - DNA, 509 bp, Homo sapiens
  misc_feature: HIJSMM301DLJR3.52.67.G01.1.454.light.4.raw
cgcagtacgacacgaccggtgctcgatttagagtatacatattgggtttggggactgatcaggactcctcagttcaccttctcacaatgaggctccctgctcagctcctggggctgctaatgctctgggtcccagcatccactggggatgttataatgactcagtctccactctccctgcccgtctcccttggacagccggcctccatctcctgcaggtctagtcaaggcctcgttttcagtgatggaaacacctacttgaattggtttcaccagaggccaggccaacctccaaggcgcctaatttataaggtttctaagcgggactctggggtcccagacagattcagcggcagtgggtcaggcactgatttctcactgcaaatcagcggggtgaggctgaggatgttggggtttattactgcatgcaaggtacacactggcctccgacgttcggccaagggaccaaggtggaatcaaacgaactgtggctgcaccatctgtcttcta

SEQ ID NO: 559457 - DNA, 490 bp, Homo sapiens
  misc_feature: HIJSMM301B38BI.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcgagggaccaaggtggagatcaaacgaactgtggctgcaccatctgtcttcatcttccgccat

SEQ ID NO: 559458 - DNA, 488 bp, Homo sapiens
  misc_feature: HIJSMM301BZRPI.48.34.D01.1.454.light.4.raw
agtatacatacacgaccggtgctcgatttagatcgtctgtgttgggtttgggggaagagctgctcagttaggacccagagggaaccatggaaaccccagcgcagcttctcttcctcctgctactctggctcccagataccaccggagcacttgtgttgacgcagtctccaggcaccctgtctttgtctccaggggagagagccaccctctcctgcagggccagtcagagtgttagcggcggctccgtagcctggtaccagcagaaacgtggccaggttcccaggctcctcatctatgatgcatccagcagggccactggcatcccagacaggttcagtggcagtgggtctgggacagacttcactctcaccatcagcagactggagcctgaagattttgcagtgtattactgtcagcagtatggtagctcacctcaactcactttcggcggagggaccaaggtggagatcaaacgaactgtggctgca

SEQ ID NO: 559459 - DNA, 490 bp, Homo sapiens
  misc_feature: HIJSMM301EUXEP.49.53.E09.1.454.light.4.raw
agtcgagagacacgaccggtgctcgatttagagagagtgtgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttaggagcaacttagcctggtatcagcagaaacctggccaggctcccagtctcctcatctttgatgcatcccgcagggccgctgacatcccagccaggttcagtggcagtgggtttgggacagacttcacgctcaccatcagcagcctagagcctgaagattttgcagtttattactgtcaacagcgtaccacaggattcactttcggccctgggaccagagtggatatcaaacgaactgtggctgcaccatctgtctt

SEQ ID NO: 559460 - DNA, 517 bp, Homo sapiens
  misc_feature: HIJSMM301EG4P5.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctgtctcccagagacgaccggagagattgtattgacgcagtctccaaccaccctgtctttgtctcctggggggagagccaccctctcctgcagggccagtgaaccttttagtagtagttatttagcctggtatcggacaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgtcggccaaggaccaaggtggcaatcaaccgaactgtggctgcaccatctgtcttcatcttccccg

SEQ ID NO: 559461 - DNA, 482 bp, Homo sapiens; identical to SEQ ID NO: 539800
  misc_feature: HIJSMM301EMNZ2.21.25.C03.1.454.light.4.raw

SEQ ID NO: 559462 - DNA, 494 bp, Homo sapiens; identical to SEQ ID NO: 534992
  misc_feature: HIJSMM301BXNMS.9.1.A01.1.454.light.4.raw

SEQ ID NO: 559463 - DNA, 476 bp, Homo sapiens
  misc_feature: HIJSMM301ESPRJ.13.4.A04.1.454.light.4.raw
  modified_base (417)..(417): a, c, t, g, unknown or other
tcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacaggggtcccatcaaggttcagtggaagtggatctgggacagattttactttcaccatcagcagcctgcagcctgaagatattgcaacatattactgtcagcagtatgataatntcccgatcaccttcggccaagggacacgactggagattaaacgaactagtggctgcaca

SEQ ID NO: 559464 - DNA, 495 bp, Homo sapiens
  misc_feature: HIJSMM301CWGQ7.26.80.H03.1.454.light.4.raw
agactatactcacgaccggtgctcgatttagctgtgcgtcgaagggaaagggactgactaccacctgcaggtcagggccaaggttatggggtcccaggttcacctcctcagcttcctcctcctttggatctctgagccgacactcacgcagtctccagcattcatgtcagcgactctaggagacaaggtcaacttctcctccaaagccagccaagacattgatgatgatatgaactggcaccaacacaaaccaggagaagctgctatttccattactcaagaaactaatggtctcctacctggaatgccacctcgactcagtggcaacaaatatggaacagtttttaccctcacaactcatatcacagaatctgaggatgctgcattttactcggtctacaacatgataatttccctccgtggacgttcggccaagggaccaaggagcaaatcaaacgaactgtggctgcaccatctgtcttcatcttcccgcat

SEQ ID NO: 559465 - DNA, 316 bp, Homo sapiens
  misc_feature: HIJSMM301CM92I.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggtt

SEQ ID NO: 559466 - DNA, 497 bp, Homo sapiens; identical to SEQ ID NO: 535286
  misc_feature: HIJSMM301DWQ8B.18.59.F04.1.454.light.4.raw

SEQ ID NO: 559467 - DNA, 495 bp, Homo sapiens; identical to SEQ ID NO: 550605
  misc_feature: HIJSMM301EI9O4.41.38.D05.1.454.light.4.raw

SEQ ID NO: 559468 - DNA, 494 bp, Homo sapiens; identical to SEQ ID NO: 534992
  misc_feature: HIJSMM301A7UPR.9.1.A01.1.454.light.4.raw

SEQ ID NO: 559469 - DNA, 494 bp, Homo sapiens; identical to SEQ ID NO: 534994
  misc_feature: HIJSMM301DXNUF.27.78.H01.1.454.light.4.raw

SEQ ID NO: 559470 - DNA, 491 bp, Homo sapiens; identical to SEQ ID NO: 555285
  misc_feature: HIJSMM301EDSME.48.1.A01.1.454.light.4.raw

SEQ ID NO: 559471 - DNA, 492 bp, Homo sapiens; identical to SEQ ID NO: 537395
  misc_feature: HIJSMM301C35W0.16.73.G07.1.454.light.4.raw

SEQ ID NO: 559472 - DNA, 465 bp, Homo sapiens
  misc_feature: HIJSMM301AYMPA.18.59.F04.1.454.light.4.raw
tacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaaccccactgtcactctgttcccgccctcctcccatactcgta

SEQ ID NO: 559473 - DNA, 498 bp, Homo sapiens
  misc_feature: HIJSMM301AUSRC.22.27.C05.1.454.light.4.raw
acatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactcttaccatcagcagcctgcaggctgaagatgtggcagtttattactgtcagcaatattatattcctcctcagacgttcggccaagggaccaaggtggaaatcaaacgaactgtggctgcacc

SEQ ID NO: 559474 - DNA, 489 bp, Homo sapiens
  misc_feature: HIJSMM301CJRCL.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatctccccactttcggccctcggaccgaaacgtggatatcaaacgaactagtggctgcaccatctgtt

SEQ ID NO: 559475 - DNA, 447 bp, Homo sapiens; identical to SEQ ID NO: 535201
  misc_feature: HIJSMM301CZPBJ.18.9.A09.1.454.light.4.raw

SEQ ID NO: 559476 - DNA, 444 bp, Homo sapiens; identical to SEQ ID NO: 535042
  misc_feature: HIJSMM301BDXAT.10.76.G10.1.454.light.4.raw

SEQ ID NO: 559477 - DNA, 504 bp, Homo sapiens; identical to SEQ ID NO: 550837
  misc_feature: HIJSMM301D4DV8.48.57.F02.1.454.light.4.raw

SEQ ID NO: 559478 - DNA, 444 bp, Homo sapiens; identical to SEQ ID NO: 536484
  misc_feature: HIJSMM301AX0SP.8.11.A11.1.454.light.4.raw

SEQ ID NO: 559479 - DNA, 472 bp, Homo sapiens; identical to SEQ ID NO: 535898
  misc_feature: HIJSMM301ESMGK.15.8.A08.1.454.light.4.raw

SEQ ID NO: 559480 - DNA, 485 bp, Homo sapiens; identical to SEQ ID NO: 536040
  misc_feature: HIJSMM301D2X0K.15.1.A01.1.454.light.4.raw

SEQ ID NO: 559481 - DNA, 520 bp, Homo sapiens
  misc_feature: HIJSMM301A7EY1.41.30.C08.1.454.light.4.raw
tctatactatcacgaccggtgctcgatttagtctgacgtcaaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgattaccatctcctgctctgggatcaacagcgaccttggtggttataactatgtgtcctggtaccaacaatatccaggcaaaccccccaaagtcatcatttatgatgtcggtagtcggccctccggggtctctagtcgcttctctggctccaagtctggcaacacggcctccctgaccatctctgggctccaggctgaggacgaggctgactattactgcagttcatatacaagcagcagcactggagtcttcggaactgggaccagggtcaccgtcctaggtcagcccaaggcccaaccccactgtcactctgttcccccg

SEQ ID NO: 559482 - DNA, 494 bp, Homo sapiens
  misc_feature: HIJSMM301BWLYD.48.20.B09.1.454.light.4.raw
agtatacatacacgaccggtgctcgatttagtgtagtgtgaagggggagtcagtctcagtcaggacacagcatggacatgagggtccccgctcagctcctggggctcctgctactctggctccgaggtgccagatgtgacatccagatgacccagtctccatcatccctgtctgcatatgtgggggacagagtcaccatcacttgccgggcaagtcagagcattagtaggtatttaaattggtatcatcaaagaccagggatggcccctaacctcctgatctacggtacatccactttgcaaagtggggtcccctcaaggttcagcggcagtggctcttggacggatttcactctcaccatcaccagtcttcaggctgaagatttaggaatttactactgtcagcagacttacagtgttccgtacacttttggccaggggaccaaactggagatgaaacgaactgtggctgcaccatctgtcttcatcttcccg

SEQ ID NO: 559483 - DNA, 491 bp, Homo sapiens; identical to SEQ ID NO: 551182
  misc_feature: HIJSMM301B8Y5C.10.25.C03.1.454.light.4.raw

SEQ ID NO: 559484 - DNA, 487 bp, Homo sapiens
  misc_feature: HIJSMM301DX177.14.55.E11.1.454.light.4.raw
  modified_base (448)..(448): a, c, t, g, unknown or other
  modified_base (452)..(452): a, c, t, g, unknown or other
  modified_base (467)..(467): a, c, t, g, unknown or other
  modified_base (477)..(477): a, c, t, g, unknown or other
  modified_base (482)..(482): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtaccccctctactcgtcggaggacgacgagngatnacagactagtggcgngcaccaactntcgtnttcta

SEQ ID NO: 559485 - DNA, 505 bp, Homo sapiens; identical to SEQ ID NO: 540772
  misc_feature: HIJSMM301CTJHH.5.24.C02.1.454.light.4.raw

SEQ ID NO: 559486 - DNA, 481 bp, Homo sapiens
  misc_feature: HIJSMM301CHNKT.13.6.A06.1.454.light.4.raw
tcacgtactacacgaccggtgctcgatttagatctactgacagggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacaacacccaggcaaagcccccaaaatcatgatttatgatgtcagtaagcggccctcaggggtccctgatcgcttctctgcctccaagtctggcaacacggcctccctgaccatctctgggctccaggctgaggatgagtctgattattactgctgctcatatgcaggcagctacactgtactattcggcggagggaccaagctgaccgtcctaggtcagcccaa

SEQ ID NO: 559487 - DNA, 492 bp, Homo sapiens; identical to SEQ ID NO: 536010
  misc_feature: HIJSMM301DWBRS.10.20.B09.1.454.light.4.raw

SEQ ID NO: 559488 - DNA, 491 bp, Homo sapiens
  misc_feature: HIJSMM301AUQSX.52.71.G05.1.454.light.4.raw
cgcagtacgacacgaccggtgctcgatttagtgtcgtcgcaagagagagggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtggcttgagctctggctcagtctctcctaatttctaccccagctggtaccagcagaccccaggccaggctccacgcacgctcatctacagcacaattactcgctcttctggggtccctgatcgcttctctggctccatccttgggaacaaagctgccctaaccatcacgggggcccaggcagatgatgaatctgattattactgtgtcctctatatgggtagtggcatttggatgttcggcggagggaccaagctgaccgtcctgggtcagcccaa

SEQ ID NO: 559489 - DNA, 498 bp, Homo sapiens
  misc_feature: HIJSMM301DUYDQ.19.78.H01.1.454.light.4.raw
tactctcgtgcacgaccggtgctcgatttagtgtgagtagtttgggtttgggggctttatttgggctctgctgctcctcactctactcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccactgtcactctgttcccgcctcctccacgagagta

SEQ ID NO: 559490 - DNA, 505 bp, Homo sapiens; identical to SEQ ID NO: 535503
  misc_feature: HIJSMM301CJKKA.8.28.C06.1.454.light.4.raw

SEQ ID NO: 559491 - DNA, 496 bp, Homo sapiens
  misc_feature: HIJSMM301B64VV.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcacgtcctaggtcagcccaagg

SEQ ID NO: 559492 - DNA, 494 bp, Homo sapiens
  misc_feature: HIJSMM301EPZJG.52.86.H09.1.454.light.4.raw
cgcagtacgacacgaccggtgctcgatttagtgctatagacttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcacgtcctgggtcagcccaaggccaacccactgtcact

SEQ ID NO: 559493 - DNA, 471 bp, Homo sapiens
  misc_feature: HIJSMM301C6RDR.48.77.G11.1.454.light.4.raw
agtatacatacacgaccggtgctcgatttagctagtcactcaagggaaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttatcactatgtctcctggtaccaacagcaccctggcaaagcccccaaactcatgatttatgatatcactaagcggccctcaggggtccctgatcgcttctctggctcccagtctggcaacacggcctccctgaccatctctgggctccaggctgaggatgaggctgattattactgctgctcatatgcaggcagctacactttggtgttcggcgggagggaccgaag

SEQ ID NO: 559494 - DNA, 485 bp, Homo sapiens; identical to SEQ ID NO: 538533
  misc_feature: HIJSMM301B7XNG.47.78.H01.1.454.light.4.raw

SEQ ID NO: 559495 - DNA, 492 bp, Homo sapiens
  misc_feature: HIJSMM301AKJOS.40.44.D11.1.454.light.4.raw
tctagcgactcacgaccggtgctcgatttagcgcagtacgaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttaacagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggccgctcactttcggcggagggaccgaaggtggagaccaaacgaaactgtggctgcaccatctgtcttctat

SEQ ID NO: 559496 - DNA, 508 bp, Homo sapiens; identical to SEQ ID NO: 536388
  misc_feature: HIJSMM301AIA8Y.11.57.F02.1.454.light.4.raw

SEQ ID NO: 559497 - DNA, 515 bp, Homo sapiens
  misc_feature: HIJSMM301APX3D.10.86.H09.1.454.light.4.raw
catagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccagaccggggacgaggccgattattactgcgcaacttgggactccaacctgactgttggggctttcggcggagggactaagttgaccgtcctacgtcagcccaaggctgcccctcggtcactctgttcccaccctcctccactactatg

SEQ ID NO: 559498 - DNA, 511 bp, Homo sapiens
  misc_feature: HIJSMM301AT2LZ.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctggtcactctgttcccaccctct

SEQ ID NO: 559499 - DNA, 508 bp, Homo sapiens; identical to SEQ ID NO: 545555
  misc_feature: HIJSMM301AEU9F.8.42.D09.1.454.light.4.raw

SEQ ID NO: 559500 - DNA, 494 bp, Homo sapiens; identical to SEQ ID NO: 534994
  misc_feature: HIJSMM301AE1N0.27.78.H01.1.454.light.4.raw

SEQ ID NO: 559501 - DNA, 481 bp, Homo sapiens
  misc_feature: HIJSMM301EYJZY.40.86.H09.1.454.light.4.raw
tctagcgactcacgaccggtgctcgatttagtgctatagacttgggtttggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccggactgttctatacagcttcaacaataagaactctgtggcttggtaccagcacaaaccaggacagcctcccaagctgctcattgactgggcatctacccggggatccggggtccctgaccgattcagtggcagcgggtctgggacagatttcactctcaccatcaccagcctgcaggctgaagatgtggcggtttattactgtcaacaatattctggtcaatctcattctttcggcggagggaccaaggtggagatcagacgaa

SEQ ID NO: 559502 - DNA, 494 bp, Homo sapiens; identical to SEQ ID NO: 534992
  misc_feature: HIJSMM301AH7ST.9.1.A01.1.454.light.4.raw

SEQ ID NO: 559503 - DNA, 492 bp, Homo sapiens
  misc_feature: HIJSMM301BUG18.15.67.G01.1.454.light.4.raw
tctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagatttcactctcaccatcagcagcctgcagcctgaagatttcgcaacttattactgtctacaagattacaattaccctcggacgtcggtccacgggaccgaacggtaggaaatacaacgaactagtggcgtgcacca

SEQ ID NO: 559504 - DNA, 485 bp, Homo sapiens
  misc_feature: HIJSMM301AED1Z.5.15.B04.1.454.light.4.raw
atcagacacgcacgaccggtgctcgatttagacagtatatatccgcgggggtcagactcagtcaggacacagcatggacatgagggtccccgctcagctcctggggctcctgctgctctggctcccaggtgccaaatgtgacatccagatgacccagtctccttccaccctgtctgcatctataggagacagagtcaccatcacttgccgggccagtcagagtattagtaactggttggcctggtatcagcagaaaccaggcaaagccccaaagctccttatctctgatgcctccactttgcacggtggggtcccaccaacgttcagcggcagtggatctgggacagaattcactctcaccatcagcagcctgcagcctgatgatgctgcaacttattactgtcaacaatataacagttattggacgttcggtccaacgggaccgaaacggtaggaaagtacaaacgaactagtggctgcaccat

SEQ ID NO: 559505 - DNA, 495 bp, Homo sapiens; identical to SEQ ID NO: 538269
  misc_feature: HIJSMM301BLBGY.9.1.A01.1.454.light.4.raw

SEQ ID NO: 559506 - DNA, 516 bp, Homo sapiens
  misc_feature: HIJSMM301C81VJ.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaaggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtctaggtcagcccaaggctgccccctcggtcactctgttcccaccctcctcacg

SEQ ID NO: 559507 - DNA, 521 bp, Homo sapiens; identical to SEQ ID NO: 538715
  misc_feature: HIJSMM301AKKYF.27.23.C01.1.454.light.4.raw

SEQ ID NO: 559508 - DNA, 514 bp, Homo sapiens; identical to SEQ ID NO: 546238
  misc_feature: HIJSMM301A6R4R.47.85.H08.1.454.light.4.raw

SEQ ID NO: 559509 - DNA, 488 bp, Homo sapiens; identical to SEQ ID NO: 537124
  misc_feature: HIJSMM301EF9II.11.25.C03.1.454.light.4.raw

SEQ ID NO: 559510 - DNA, 501 bp, Homo sapiens
  misc_feature: HIJSMM301DSSSA.26.80.H03.1.454.light.4.raw
agactatactcacgaccggtgctcgatttagctgtgcgtcgaagggaaagggactgactaccacctgcaggtcagggccaaggttatggggtcccaggttcacctcctcagcttcctcctcctttggatctctgagccgacactcacgcagtctccagcattcatgtcagcgactctaggagacaaggtcaacttctcctccaaagccagccaagacattgatgatgatatgaactggcaccaacacaaaccaggagaagctgctatttccattactcaagaaactaatggtctcctacctggaatgccacctcgactcagtggcaacaaatatggaacagttttaccctcacaactcatatcacagaatctgaggatgctgcattttacttcggtctacaacatgataatttccctccgttggacgttcggccaagggaccaaggagcaaaatcaaaacgaaacctgtggctgcaccatctgtcttcatcttcccgccat

SEQ ID NO: 559511 - DNA, 505 bp, Homo sapiens
  misc_feature: HIJSMM301EOLWP.12.48.E04.1.454.light.4.raw
atacgacgtacacgaccggtgctcgatttagagagcgtcacagagagaaggggagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatttcttgttctggaacccactccaacatcggatataattctgtagactggtaccagcagcttccaggagccggccccccgactcctcatctttaataacaatcagcggccctcaggggtccctgaccgattctctggctccaagtctggcacctcagcctccctggccatcagtgggctccagtctgaggatgaggctgattattactgtgcatcatgggctgacaccctgactggtccgggagtgttcggcggagggaccaagctgaccgtcctaggtcagcccaaggcagccccctggtcactc

SEQ ID NO: 559512 - DNA, 510 bp, Homo sapiens; identical to SEQ ID NO: 535474
  misc_feature: HIJSMM301AOHWR.17.33.C11.1.454.light.4.raw

SEQ ID NO: 559513 - DNA, 502 bp, Homo sapiens; identical to SEQ ID NO: 544411
  misc_feature: HIJSMM301ES7K4.4.71.G05.1.454.light.4.raw

SEQ ID NO: 559514 - DNA, 490 bp, Homo sapiens
  misc_feature: HIJSMM301DO883.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcggcggagggaccgaaggtggagatcaaacgaacta

SEQ ID NO: 559515 - DNA, 502 bp, Homo sapiens; identical to SEQ ID NO: 535463
  misc_feature: HIJSMM301BK5TF.43.86.H09.1.454.light.4.raw

SEQ ID NO: 559516 - DNA, 505 bp, Homo sapiens; identical to SEQ ID NO: 535503
  misc_feature: HIJSMM301CFIOL.8.28.C06.1.454.light.4.raw

SEQ ID NO: 559517 - DNA, 444 bp, Homo sapiens; identical to SEQ ID NO: 552512
  misc_feature: HIJSMM301A8MC3.5.9.A09.1.454.light.4.raw

SEQ ID NO: 559518 - DNA, 347 bp, Homo sapiens
  misc_feature: HIJSMM301AJA7K.13.11.A11.1.454.light.4.raw
tcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcactttattctgtcaccagtatggtaggtcaccgtacacttttggccaggggaccaagctggagatcaagcgaactgtggctgcaccatctgtcttcatctcccgcatctgatagtacgtga

SEQ ID NO: 559519 - DNA, 492 bp, Homo sapiens
  misc_feature: HIJSMM301ATU68.26.23.C01.1.454.light.4.raw
  modified_base (433)..(433): a, c, t, g, unknown or other
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattctccancgttcggccaggggaccgaaggtaggaagtacaagacgaactgtggctgcaccatctgt

SEQ ID NO: 559520 - DNA, 494 bp, Homo sapiens; identical to SEQ ID NO: 534992
  misc_feature: HIJSMM301BYRJ8.9.1.A01.1.454.light.4.raw

SEQ ID NO: 559521 - DNA, 486 bp, Homo sapiens; identical to SEQ ID NO: 535385
  misc_feature: HIJSMM301CWGDE.19.71.G05.1.454.light.4.raw

SEQ ID NO: 559522 - DNA, 498 bp, Homo sapiens
  misc_feature: HIJSMM301ASQ4Q.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtcccgtgaccgattcagtggcagcgggtctgggacagatttcactctcaccatcagcagcctgcaggctgaagatgtggcagtttattattgtcagcaatattatattcctcctcagacgttcggccaagggaccaaggtggaaatcaaacgaactgtggctgcacca

SEQ ID NO: 559523 - DNA, 483 bp, Homo sapiens; identical to SEQ ID NO: 548593
  misc_feature: HIJSMM301AWD06.51.52.E08.1.454.light.4.raw

SEQ ID NO: 559524 - DNA, 511 bp, Homo sapiens
  misc_feature: HIJSMM301EZXKR.15.28.C06.1.454.light.4.raw
  modified_base (489)..(489): a, c, t, g, unknown or other
  modified_base (502)..(502): a, c, t, g, unknown or other
tctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaaagtcctgatctctgccgcctctactttgcaaagtggggtcccatcaaggttcagcggcagtggatctgggacagaattcagtctcaccatcagcagcctgcagcctgacgattttgcaacttactaactgccaaagtgcataataaatctaattcggtcgggacggggaccggaaacggtagggaggaatcaaacgaaaacgtagtggngtcgcaccatctntcttctatt

SEQ ID NO: 559525 - DNA, 357 bp, Homo sapiens
  misc_feature: HIJSMM301DVGT7.49.29.C07.1.454.light.4.raw
agtcgagagacacgaccggtgctcgatttagagtgctacgaagggaaagggaacatcggaagtaactttgcttactggtaccaacaactcccaggaacggcccccaaattcctcttgtataggagtaatcagcggccctcaggggtccctgaccgattctctggctcccagtctggcacctcagcctccctggccatcagtggcctccggtccgaggatgaggctgattattattgtgcagcatgggatgacagcctgagtggtctcgtcttcggagctgggaccaaggtcaccgtcctaggtcagcccaaggccaaccccactgtcactctgttcccaccctcctctctctcgact

SEQ ID NO: 559526 - DNA, 506 bp, Homo sapiens
  misc_feature: HIJSMM301D4CPG.14.57.F02.1.454.light.4.raw
cgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatccccagccaggttcagtggcagcgggtctgggacagacttcactctcaccatcagcagcctagagtctgaagattttgcagtttattactgtcagcagcggggcaattggccgctcactttcggcgggggaccgaaggtggagttcaaacgaactgtaggctgcaccatctgtcttcactcttcccg

SEQ ID NO: 559527 - DNA, 489 bp, Homo sapiens; identical to SEQ ID NO: 535139
  misc_feature: HIJSMM301ENS25.14.55.E11.1.454.light.4.raw

SEQ ID NO: 559528 - DNA, 495 bp, Homo sapiens
  misc_feature: HIJSMM301AV8JC.16.53.E09.1.454.light.4.raw
tgtactactccacgaccggtgctcgatttagagagagtgtgttgggtttggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactagaaaatcagcagagtggaggctgaggatggttggggtttattactgcatgcaagctctaacaaactccttactacttttggccaggggaccaagctggagatacaaacgaactgt

SEQ ID NO: 559529 - DNA, 483 bp, Homo sapiens
  misc_feature: HIJSMM301EMU4Z.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgaggtattttgcaacttattactgtctacaagattacacttaccctggtacgttcggccgaagggaccaaggtaggaaatacaaacgaactgtggctgcacc

SEQ ID NO: 559530 - DNA, 486 bp, Homo sapiens
  misc_feature: HIJSMM301BHK4Z.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgatctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaggcggagatcagacgaactgtggctgcaccatctgtctt

SEQ ID NO: 559531 - DNA, 520 bp, Homo sapiens; identical to SEQ ID NO: 537173
  misc_feature: HIJSMM301CMLAF.27.23.C01.1.454.light.4.raw

SEQ ID NO: 559532 - DNA, 495 bp, Homo sapiens
  misc_feature: HIJSMM301BTB5B.21.27.C05.1.454.light.4.raw
  modified_base (198)..(198): a, c, t, g, unknown or other
tcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttagcctggtaccagcagaaatctggccaggctcccaggctcctcatttaccgtgcatccaccagggccactggtgtcccagacaggttcagtggcggtggatttgggacagagttttctctcaccatcagcgccctacagagtgaagatgttgcagtttattctgccagcaatataattactggcctgcgtcgacgttcggccacgggaccgaaggtggaaatcaaacgaactgtggctgcaccatctgtctt

SEQ ID NO: 559533 - DNA, 498 bp, Homo sapiens; identical to SEQ ID NO: 553891
  misc_feature: HIJSMM301CL7U3.3.33.C11.1.454.light.4.raw

SEQ ID NO: 559534 - DNA, 481 bp, Homo sapiens; identical to SEQ ID NO: 545581
  misc_feature: HIJSMM301CC1QK.48.19.B08.1.454.light.4.raw

SEQ ID NO: 559535 - DNA, 469 bp, Homo sapiens; identical to SEQ ID NO: 536091
  misc_feature: HIJSMM301ALL41.3.82.H05.1.454.light.4.raw

SEQ ID NO: 559536 - DNA, 498 bp, Homo sapiens
  misc_feature: HIJSMM301D1H31.40.57.F02.1.454.light.4.raw
tctagcgactcacgaccggtgctcgatttagctcgatatagttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttattttgctgctcttatgcaggcagtttcgctctcgaagtgttcggcggagggaccgagctgaccgtcctacgtcagcccaaggctccg

SEQ ID NO: 559537 - DNA, 486 bp, Homo sapiens; identical to SEQ ID NO: 535917
  misc_feature: HIJSMM301C2YYE.3.10.A10.1.454.light.4.raw

SEQ ID NO: 559538 - DNA, 518 bp, Homo sapiens
  misc_feature: HIJSMM301EQMSU.3.87.H10.1.454.light.4.raw
agacgcactccacgaccggtgctcgatttagcagtactgcgttgggtttggggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggatccaccggtgacgttgctacttataagtttgtctcctggtcctggtaccaaaaacacccaggcaaagcccccagattaatgatttatgatgtcagtgatcggccctcaggggtttctcatcgcttttctggctccaagtctggcaacacggcctccctgaccatctctgggctccaggctgaggacgaggctgattatttctgcagctcatacacaaccggcaccactgtcgtggttttcggtggagggaccaagctgaccgtcctaggtcagcccaaggctgccccctcggtcactc

SEQ ID NO: 559539 - DNA, 515 bp, Homo sapiens; identical to SEQ ID NO: 538805
  misc_feature: HIJSMM301BWTU6.14.19.B08.1.454.light.4.raw

SEQ ID NO: 559540 - DNA, 489 bp, Homo sapiens
  misc_feature: HIJSMM301EJ427.3.55.E11.1.454.light.4.raw
agacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtatcccagccaggttcagtggcagtgggtctgggacagagttcattctcaccatcagcagcctgcagtctgaagattttgcaatttattactgtcagcagtataataactggtggacgttcggccaagggaccaaaggtagaaaatcaaacgaactgtggctgcaccatctgt

SEQ ID NO: 559541 - DNA, 505 bp, Homo sapiens; identical to SEQ ID NO: 535503
  misc_feature: HIJSMM301DU3JQ.8.28.C06.1.454.light.4.raw

SEQ ID NO: 559542 - DNA, 487 bp, Homo sapiens
  misc_feature: HIJSMM301AZFJW.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattctccagcgttcggccaggggaccaaggtggaagtcaagcgaactgtggctgcacatctgt

SEQ ID NO: 559543 - DNA, 490 bp, Homo sapiens; identical to SEQ ID NO: 535526
  misc_feature: HIJSMM301CIX8H.26.78.H01.1.454.light.4.raw

SEQ ID NO: 559544 - DNA, 487 bp, Homo sapiens
  misc_feature: HIJSMM301DMUQJ.26.55.E11.1.454.light.4.raw
agactatactcacgaccggtgctcgatttagcactcgcacgttgggtttgggggcaggagtcagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggcaagtgagggcataaacaaattcttaaattggtatcaggagaaaccagggagagcccctaaggtcctgatctatggtgcatccattttgcaaagtggggtcccaccaaatttcagtggcagtggatctgggacagatttcactctcagcattaataatctgcaacctgaggattttgcaacttactactgtcaacagagttacaggcccccctatacttttggccagggaccaagctggagatcacaggaactgtggctgcaccat

SEQ ID NO: 559545 - DNA, 463 bp, Homo sapiens; identical to SEQ ID NO: 535062
  misc_feature: HIJSMM301AYIRB.11.73.G07.1.454.light.4.raw

SEQ ID NO: 559546 - DNA, 484 bp, Homo sapiens; identical to SEQ ID NO: 535400
  misc_feature: HIJSMM301C4TKD.46.26.C04.1.454.light.4.raw

SEQ ID NO: 559547 - DNA, 520 bp, Homo sapiens; identical to SEQ ID NO: 555124
  misc_feature: HIJSMM301DRDFI.27.23.C01.1.454.light.4.raw

SEQ ID NO: 559548 - DNA, 487 bp, Homo sapiens; identical to SEQ ID NO: 548429
  misc_feature: HIJSMM301CFT84.47.70.G04.1.454.light.4.raw

SEQ ID NO: 559549 - DNA, 490 bp, Homo sapiens; identical to SEQ ID NO: 542396
  misc_feature: HIJSMM301DZON8.16.53.E09.1.454.light.4.raw

SEQ ID NO: 559550 - DNA, 383 bp, Homo sapiens; identical to SEQ ID NO: 447524
  misc_feature: HIJSMM301ATRSB.41.26.C04.1.454.light.4.raw

SEQ ID NO: 559551 - DNA, 443 bp, Homo sapiens
  misc_feature: HIJSMM301EM7EE.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgttcccaccctcctcgacacgcga

SEQ ID NO: 559552 - DNA, 486 bp, Homo sapiens; identical to SEQ ID NO: 535043
  misc_feature: HIJSMM301A2994.46.35.D02.1.454.light.4.raw

SEQ ID NO: 559553 - DNA, 491 bp, Homo sapiens
  misc_feature: HIJSMM301EH7N2.27.78.H01.1.454.light.4.raw
agcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaacgaactgtggctgcacatctgt

SEQ ID NO: 559554 - DNA, 510 bp, Homo sapiens
  misc_feature: HIJSMM301C1QR5.3.37.D04.1.454.light.4.raw
agacgcactccacgaccggtgctcgatttagtagcatactgttgggtttggggggggtctcaggaggcagcgctctcgggacgtctccaccatggcctgggctctgctattcctcaccctcctcactcagggcacagggtcctgggcccagtctgccctgagtcagcctgcctccgtgtctgggtctcctggacagtcgatcaccatctcctgcactggaaccagcagtgacgttggtagatataattatgtctcctggtaccaacaactcccaggcaaacgcccccaaactgatgatttatgatgtcaataatcggccctcaggggtttctaatcgcttctctggctccaagtctggcaacacggcctccctgaccatctctgggctccagggtgaggacgaggctgattattactgcagctcatttacaagcagcaccactcaggtcttcggaactgggactaaggtcaccgtcctaggtcagcccaaggcccaaccccactgtcact

SEQ ID NO: 559555 - DNA, 467 bp, Homo sapiens
  misc_feature: HIJSMM301EYSKP.49.8.A08.1.454.light.4.raw
  modified_base (415)..(415): a, c, t, g, unknown or other
agtcgagagacacgaccggtgctcgatttagcatactctacaggggaggtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctgaattggtatcagcaaaaccagggacagcccctaagctcctgatcctcgatgcatccactttggaaacaggggtcccatcaaggttcagtggaagtggctctgggacagtattttactttcaccatcagcagactgcagcctgaagatattgcaacatattactgtcaacagtatgatcncctcccgcctctacgtttcggcggggggaccgaacggtggagatcagacgaa

SEQ ID NO: 559556 - DNA, 504 bp, Homo sapiens; identical to SEQ ID NO: 536107
  misc_feature: HIJSMM301DYRRC.41.33.C11.1.454.light.4.raw

SEQ ID NO: 559557 - DNA, 501 bp, Homo sapiens
  misc_feature: HIJSMM301A8WDA.51.29.C07.1.454.light.4.raw
cgatcgtatacacgaccggtgctcgatttagagtgctacgaagggaaaggggactgatcaggactcctcagttcaccttctcacaatgaggctccctgctcagctcctggggctgctaatgctctgggtcccaggatgcactggggatgttgtggtgactcagtctcctctctccctgcccgtcacccttggacaggcggcctccatctcctgcaggtctagtcacagcctcctacacagtgatggaaacacctacttgacttggtttcagcagaggcctggccaatctccaaggcgccttatttataaggtttctaatcgggactttggggtcccagacagattcagcggcagtgggtcacgcactcacttcacactgaaaatcagcagggtggaggctgaggatttaggggtttattactgcatgcaaggtacacactggcctccgtacacttttggccaggggaccaagctcgagatcaaacgaactgtggctgcacc

SEQ ID NO: 559558 - DNA, 595 bp, Homo sapiens
  misc_feature: HIJSMM301CHUAH.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcggggcctccgggggtcctcgtagacgtacggttacgtaggtcggcgtaggtaggtactacggacggaccaacgaagttttaacttttaacctacgtaaaagtaaaactacgacgacgaaggtaggtaggggacggtcgtagggaaggtaggttggggttttaggggttttaactttacgtcgactagtcgacgaacgtctactaaactaaccttacctactttacgtttcgacggacggaacgaacgcgtaggagtataacgaaacgtaacgt

SEQ ID NO: 559559 - DNA, 460 bp, Homo sapiens; identical to SEQ ID NO: 537107
  misc_feature: HIJSMM301D0H68.22.28.C06.1.454.light.4.raw

SEQ ID NO: 559560 - DNA, 492 bp, Homo sapiens
  misc_feature: HIJSMM301CJQYK.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttacacttttggccaggggaccaagctggagatcaaacgaaactgt

SEQ ID NO: 559561 - DNA, 513 bp, Homo sapiens
  misc_feature: HIJSMM301DWCW6.17.33.C11.1.454.light.4.raw
  modified_base (507)..(507): a, c, t, g, unknown or other
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccncctcct

SEQ ID NO: 559562 - DNA, 354 bp, Homo sapiens; identical to SEQ ID NO: 535026
  misc_feature: HIJSMM301C4DR4.19.22.B11.1.454.light.4.raw

SEQ ID NO: 559563 - DNA, 504 bp, Homo sapiens; identical to SEQ ID NO: 535709
  misc_feature: HIJSMM301CD3T7.9.55.E11.1.454.light.4.raw

SEQ ID NO: 559564 - DNA, 494 bp, Homo sapiens
  misc_feature: HIJSMM301D5Y2K.19.25.C03.1.454.light.4.raw
tactctcgtgcacgaccggtgctcgatttagtagtgtagatttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggcctcagactttcggtggagggaccgaaggtggaggatcaaacgaactagtggctgcaccatctgtt

SEQ ID NO: 559565 - DNA, 495 bp, Homo sapiens; identical to SEQ ID NO: 535486
  misc_feature: HIJSMM301AZVWY.26.72.G06.1.454.light.4.raw

SEQ ID NO: 559566 - DNA, 486 bp, Homo sapiens; identical to SEQ ID NO: 535385
  misc_feature: HIJSMM301DSMSO.19.71.G05.1.454.light.4.raw

SEQ ID NO: 559567 - DNA, 482 bp, Homo sapiens; identical to SEQ ID NO: 535352
  misc_feature: HIJSMM301EF3CD.16.81.H04.1.454.light.4.raw

SEQ ID NO: 559568 - DNA, 465 bp, Homo sapiens; identical to SEQ ID NO: 539935
  misc_feature: HIJSMM301B933N.3.20.B09.1.454.light.4.raw

SEQ ID NO: 559569 - DNA, 484 bp, Homo sapiens
  misc_feature: HIJSMM301D8SAL.10.1.A01.1.454.light.4.raw
catagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagctcctctccgacaggaataacatccggccctcagggatctcagagagattctctgcatccaggtcaggaagcacagcctccctgaccattactggactccaggctgacgacgaagctgattattactgctcagcatggacaccggcctcagtgcgtgggttttcggcggagggaccaagctgaccgtcctaggtcagaccccg

SEQ ID NO: 559570 - DNA, 470 bp, Homo sapiens
  misc_feature: HIJSMM301AN622.51.1.A01.1.454.light.4.raw
cgatcgtatacacgaccggtgctcgatttagacgtctcatcagggggcaggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctgaattggtatcagcaaaaaccagggaaagcccctaagctcctgatcctcgatgcatccaatttggaaacaggggtcccatcaaggttcagtgcaagtggctctgggacagatttcactttcaccatcagcagactgcagcctgaagatattgcaacatattactgtcaacagtatgataatctcccgctcactttcggcggagggaccaaggtggggatcaaacgaactgt

SEQ ID NO: 559571 - DNA, 493 bp, Homo sapiens
  misc_feature: HIJSMM301CM9TK.43.37.D04.1.454.light.4.raw
tgtgagtagtcacgaccggtgctcgatttagtagcatactgttgggtttggggagcttcagctgtgggtagagaagacaggactcaggacaatctccagcatggccagcttccctctcctcctcaccctcctcactcactgtgcagggtcctgggcccagtctgtggtgactcagccaccctcagcgtctgggacccccggacagagggtcagcatctcctgttctggaagcagctccaacattggacgtaatactgtaaactggtaccagcaactcgcaggaacggcccccaaactcctcatctatgaccatcatcagcggccctcaggggtccctgaccgattctctggctccaagtctggctcttcagcctccctggccatcagtgggctccagtctgaggatgaggctgattattactgtgcagcgtgggatgacagcctgaatgcttgggtgttcggcggagggaccaaggtgaccgtcctaggtcag

SEQ ID NO: 559572 - DNA, 493 bp, Homo sapiens; identical to SEQ ID NO: 557954
  misc_feature: HIJSMM301CCY0U.40.11.A11.1.454.light.4.raw

SEQ ID NO: 559573 - DNA, 514 bp, Homo sapiens
  misc_feature: HIJSMM301C93Z7.10.26.C04.1.454.light.4.raw
catagtagtgcacgaccggtgctcgatttagtctagcgactttgggtttggggtgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccaaggtggcaatcaaccgaactgtggctgcaccatctgtcttcatcttcccgccatctgaccactac

SEQ ID NO: 559574 - DNA, 513 bp, Homo sapiens
  misc_feature: HIJSMM301CQSUT.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctcgttcccacctcct

SEQ ID NO: 559575 - DNA, 485 bp, Homo sapiens; identical to SEQ ID NO: 536307
  misc_feature: HIJSMM301AH0YZ.46.35.D02.1.454.light.4.raw

SEQ ID NO: 559576 - DNA, 499 bp, Homo sapiens; identical to SEQ ID NO: 543887
  misc_feature: HIJSMM301BD3ZK.10.65.F10.1.454.light.4.raw

SEQ ID NO: 559577 - DNA, 502 bp, Homo sapiens; identical to SEQ ID NO: 541971
  misc_feature: HIJSMM301BMWFI.4.39.D06.1.454.light.4.raw

SEQ ID NO: 559578 - DNA, 489 bp, Homo sapiens; identical to SEQ ID NO: 543840
  misc_feature: HIJSMM301EZ6VU.12.88.H11.1.454.light.4.raw

SEQ ID NO: 559579 - DNA, 520 bp, Homo sapiens; identical to SEQ ID NO: 554405
  misc_feature: HIJSMM301EMATI.5.27.C05.1.454.light.4.raw

SEQ ID NO: 559580 - DNA, 501 bp, Homo sapiens; identical to SEQ ID NO: 535603
  misc_feature: HIJSMM301C3R8L.21.38.D05.1.454.light.4.raw

SEQ ID NO: 559581 - DNA, 513 bp, Homo sapiens
  misc_feature: HIJSMM301C77X0.43.59.F04.1.454.light.4.raw
tgtgagtagtcacgaccggtgctcgatttagtacacacacttagggagttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaagcccccaaactcttgatttatgatgtcacttatcggccctcaggggtttccttatcgcttctctggctccaagtctggcaacacggcctcctgaccatctctgggctccaggctgaggacgaggctgattattactgcaactcacttacaacgaccgacacttgcgtattcggcggcgggaccaagctgaccgtcctaggtcagcccaaggctgccccctcggtcactc

SEQ ID NO: 559582 - DNA, 473 bp, Homo sapiens; identical to SEQ ID NO: 546369
  misc_feature: HIJSMM301B94B9.18.76.G10.1.454.light.4.raw

SEQ ID NO: 559583 - DNA, 486 bp, Homo sapiens; identical to SEQ ID NO: 535043
  misc_feature: HIJSMM301EQ8TP.46.35.D02.1.454.light.4.raw

SEQ ID NO: 559584 - DNA, 493 bp, Homo sapiens
  misc_feature: HIJSMM301BSGXP.4.27.C05.1.454.light.4.raw
agcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagttgtgtgttggtatcaagtgaggccaggccagtcccctcttttagtcatgtatcgggatagaaagcggccctcagggatccctgagcgcttctctggatccaactctgggaacacagccactctgaccatcagcgggacccaacttttagatgaggccgactatttctgtcacacgtgggacatgggcactgcgatcttcggcggagggaccaagctgaccgtcctgggtcagcccaaggctgccccctcggtcact

SEQ ID NO: 559585 - DNA, 492 bp, Homo sapiens
  misc_feature: HIJSMM301EEYW7.16.86.H09.1.454.light.4.raw
tgtactactccacgaccggtgctcgatttagtgctatagacttgggtttgggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcggcggtgggaccaagctgaccgtctaggtcagccaagg

SEQ ID NO: 559586 - DNA, 507 bp, Homo sapiens
  misc_feature: HIJSMM301AFG3A.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctggaccaaattagagatcaaacgaactgtggctgcaccatctgtcttctatcttcccgccact

SEQ ID NO: 559587 - DNA, 502 bp, Homo sapiens
  misc_feature: HIJSMM301BRG1A.48.3.A03.1.454.light.4.raw
agtatacatacacgaccggtgctcgatttagagagcgtcacagggggagtcagacccagtcaggacacagcatggacatgagggtccccgctcagctcctggggctcctgctgctctggctcccaggtgccaagtgtgccatccagatgacccagtctccttccaccctgtctgcatctgtgggagacagcgtcaccatcacttgccgggccagtcagaatattaatgactggttggcctggtatcaacagaaaccagggaaagcccctaaacttctgatctttcaggcatctaatttagaacatggggtcccatcaaggttcagcggcagtgggtttggcacagacttcactctcaccatcgccagcctgcagcccgatgattttgcaacttatttctgccaacagtatcatacttattctcggaccttcggtccaagggaccgagggtggaaagtacaaacgaactagtggctgcaccactctgtcttctatcttccccg

SEQ ID NO: 559588 - DNA, 507 bp, Homo sapiens
  misc_feature: HIJSMM301ELKFX.19.78.H01.1.454.light.4.raw
tactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaacccccactgtcta

SEQ ID NO: 559589 - DNA, 515 bp, Homo sapiens
  misc_feature: HIJSMM301A1HSN.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccgggcgtcgtccacggacgaacggtaggaagtacgaacgaacgtacgtggcgtgcgaccactctgtcttctactcttcccgtccact

SEQ ID NO: 559590 - DNA, 484 bp, Homo sapiens
  misc_feature: HIJSMM301BQZXJ.49.81.H04.1.454.light.4.raw
agtcgagagacacgaccggtgctcgatttagtagtgtagattcgcgggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatctaccactcactttcggcggagggaccacggtggagatcaaacgaactgtggctgcaccatctgtcttcta

SEQ ID NO: 559591 - DNA, 515 bp, Homo sapiens
  misc_feature: HIJSMM301C34UA.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtccactctgttcccgccctcctcc

SEQ ID NO: 559592 - DNA, 484 bp, Homo sapiens
  misc_feature: HIJSMM301D08CM.47.78.H01.1.454.light.4.raw
agctcacgtacacgaccggtgctcgatttagtgtgagtagtttgggtttgggaacctatgaacattctgtaggggccactgtcttctccacggtgctcccttcatgcgtgactcagccaccctcagcgtctgggacccccgggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcagcctccctggccatcagtgggctccggtccgaggatgaggctgattattattgtgcaacatgggatagtagcctgagtagtgtggttttcggcggagggaccaaactgaccgtcctaggtcagcccaaggctgccccctcggtcactctgttcccgcctcctctacgtgagct

SEQ ID NO: 559593 - DNA, 488 bp, Homo sapiens; identical to SEQ ID NO: 538291
  misc_feature: HIJSMM301EA3EC.19.71.G05.1.454.light.4.raw

SEQ ID NO: 559594 - DNA, 489 bp, Homo sapiens; identical to SEQ ID NO: 535091
  misc_feature: HIJSMM301EQTOF.47.36.D03.1.454.light.4.raw

SEQ ID NO: 559595 - DNA, 481 bp, Homo sapiens; identical to SEQ ID NO: 535993
  misc_feature: HIJSMM301AIXID.21.25.C03.1.454.light.4.raw

SEQ ID NO: 559596 - DNA, 505 bp, Homo sapiens
  misc_feature: HIJSMM301CQ2T7.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctggggacagacttcactctcaccatcatcagcctggagcctgaagatgttgcagtttattactgtcaacatcgtaccgagtggcctccgggggccactttcggccctgggaccaagtggatatcaaacgaactgtggctgcaccatctgtctt

SEQ ID NO: 559597 - DNA, 520 bp, Homo sapiens
  misc_feature: HIJSMM301EXJYC.48.34.D01.1.454.light.4.raw
agtatacatacacgaccggtgctcgatttagatcgtctgtgttgggtttggggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgatgtcactaagcggccctcgggggtccctgatcgcttctctggctccaagtctggcaacacggcctccctgaccatctctgggctccaggctgaagatcaggctgattattactgctgttcattttcaagttcctttttgtcttcggaactgggaccgaggtcaccgtcctaggtcagcccaaggccaaccccactgtcactctgttcccacctcct

SEQ ID NO: 559598 - DNA, 492 bp, Homo sapiens; identical to SEQ ID NO: 537509
  misc_feature: HIJSMM301CFKHQ.13.46.E02.1.454.light.4.raw

SEQ ID NO: 559599 - DNA, 494 bp, Homo sapiens
  misc_feature: HIJSMM301B7FDV.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttggcacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggcggagggaccagggtggagatcaaacgaactgtggctgcaccatcctgtcttcatt

SEQ ID NO: 559600 - DNA, 486 bp, Homo sapiens; identical to SEQ ID NO: 536323
  misc_feature: HIJSMM301D0ZWB.10.2.A02.1.454.light.4.raw

SEQ ID NO: 559601 - DNA, 513 bp, Homo sapiens
  misc_feature: HIJSMM301A987J.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcgacggagggaccaagctgaccgtcttaagtcagcccaaggctgccccctcggtcactctgttcccaccctcct

SEQ ID NO: 559602 - DNA, 509 bp, Homo sapiens
  misc_feature: HIJSMM301C1CSP.15.34.D01.1.454.light.4.raw
tctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtggggcgtggcatttgggtgttcggcggagggaccaaactgaccgtcctaggtcagcccaaggctgccccctggtcact

SEQ ID NO: 559603 - DNA, 476 bp, Homo sapiens
  misc_feature: HIJSMM301B9F0F.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtctaacagagttccactaccccaatcacttcggccctgggactgagtgcatatgaagagaactgtggctgcta

SEQ ID NO: 559604 - DNA, 516 bp, Homo sapiens
  misc_feature: HIJSMM301DDDQU.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctactgactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccaggggtggtgttcggcggagggaccaagctggccgtcctaggtcagcccaaggctgccccctcggtcactctgttccccgccctcctcgagtagtaca

SEQ ID NO: 559605 - DNA, 485 bp, Homo sapiens; identical to SEQ ID NO: 536263
  misc_feature: HIJSMM301CY1OC.47.78.H01.1.454.light.4.raw

SEQ ID NO: 559606 - DNA, 512 bp, Homo sapiens
  misc_feature: HIJSMM301B2140.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtccccccggacgttcgtccacgggaccgacacgtagaaatagagacgaactagtggcgtgcgaccactctgtcttctactcttcccgt

SEQ ID NO: 559607 - DNA, 479 bp, Homo sapiens
  misc_feature: HIJSMM301CUASO.5.28.C06.1.454.light.4.raw
atcagacacgcacgaccggtgctcgatttagagctcacgtattgggtttgggggagtcagtcccaaccaggacacagcatggacatgagggtccctgctcagctcctggggctcctgctgctctggctctcaggtgccagatgtgacatccagatgacccagtctccatcgtccgtgtctgcatctgtaggagacagagtcaccatcacttgtcaggcgagtcaggacattggtaattacttaacttggtatcagcagaaaccagggaaagtccccaaactcctgatctacgatgcatctaatttggaaataggggtctcatcaaggttcagtgggagtggatctgggacagaattcactttcaccatcagcagcctgcaacctgaagatattgcaacatattactgtcaacagtatgatagtctggccgccttcggcggagggaccaaggtggagatcgaacgaactgtggctggcaa

SEQ ID NO: 559608 - DNA, 522 bp, Homo sapiens; identical to SEQ ID NO: 543352
  misc_feature: HIJSMM301EB1UV.27.23.C01.1.454.light.4.raw

SEQ ID NO: 559609 - DNA, 485 bp, Homo sapiens
  misc_feature: HIJSMM301ANRQP.49.81.H04.1.454.light.4.raw
agtcgagagacacgaccggtgctcgatttagtagtgtagattcgcggggagtcagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatctaccactcactttcggtcggagggaccgacggtggagatcaaacgaactgtggctgcaccatctgt

SEQ ID NO: 559610 - DNA, 509 bp, Homo sapiens
  misc_feature: HIJSMM301AKE4S.8.42.D09.1.454.light.4.raw
  modified_base (505)..(505): a, c, t, g, unknown or other
ctcgcgtgtccacgaccggtgctcgatttagacacatacgcagggaaaggggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcggcggagggaccaagttgaccgtcctaggtcagcccaaggctgccccctcggtcactctgttcccnccct

SEQ ID NO: 559611 - DNA, 505 bp, Homo sapiens
  misc_feature: HIJSMM301CC9U2.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggttattactgcatgcaaactacacacggccgctcactttcggcggagggaccaaggtggagatcaaacgaactgtggctgcaccatctgtt

SEQ ID NO: 559612 - DNA, 491 bp, Homo sapiens
  misc_feature: HIJSMM301BPE1H.52.71.G05.1.454.light.4.raw
cgcagtacgacacgaccggtgctcgatttagtgtcgtcgcaagagagagggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtggcttgagctctggctcagtctctcctaatttctaccccagctggtaccagcagaccccaggccaggctccacgcacgctcatctacagcacaattactcgctcttctggggtccctgatcgcttctctggctccatccttgggaacaaagctgccctaaccatcacggggcccaggcagatgatgaatctgattattactgtgtcctctatatgggtagtggcatttggatgttcggcggagggaccaagctgaccgtcctgggtcagcccaac

SEQ ID NO: 559613 - DNA, 490 bp, Homo sapiens
  misc_feature: HIJSMM301BO5HM.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgagacagaattcactctcactatcaccagcctgcaacctgatgattttgcaacttattactgccaacagtatcatcatcattgtaatttcggtggagggaccaaggtggaggtcaaacgaactgtggctgcaccatctgtcttcta

SEQ ID NO: 559614 - DNA, 455 bp, Homo sapiens
  misc_feature: HIJSMM301ADJ48.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattcctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccgccctcctccacgagagta

SEQ ID NO: 559615 - DNA, 502 bp, Homo sapiens
  misc_feature: HIJSMM301DTOPX.21.81.H04.1.454.light.4.raw
tcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacgaggctgattattactgcaggtcatatacaatcagcaacacttatgtcttcgggactgggaccaagatcaccgtcctaggtcagcccaaggcccaacccactgtca

SEQ ID NO: 559616 - DNA, 484 bp, Homo sapiens
  misc_feature: HIJSMM301AZQBF.5.34.D01.1.454.light.4.raw
atcagacacgcacgaccggtgctcgatttagatcgtctgtgttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactatgtcaacaggctaacagtttccctccgacctcgtccaacggacacgactggagattaaacgaactagtggctgcacctaa

SEQ ID NO: 559617 - DNA, 497 bp, Homo sapiens
  misc_feature: HIJSMM301EG47D.51.83.H06.1.454.light.4.raw
cgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaagagccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacagacttcgctctcaccatcagcagcctagagcctgaagattttgcagtttattattgtcagcagcgaaacaactggcctccttggacgttcggccaagggaccaaggtggaatcaaacgaactgtggctgcaccatctgtcttcattcc

SEQ ID NO: 559618 - DNA, 506 bp, Homo sapiens
  misc_feature: HIJSMM301CLKGF.10.55.E11.1.454.light.4.raw
catagtagtgcacgaccggtgctcgatttagcactcgcacgttgggtttgggggagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaaggaccaaggtggcaatcaaccgaactgtggctgcaccatctgtcttcatcttcccgccat

SEQ ID NO: 559619 - DNA, 485 bp, Homo sapiens; identical to SEQ ID NO: 535880
  misc_feature: HIJSMM301AQTYD.7.75.G09.1.454.light.4.raw

SEQ ID NO: 559620 - DNA, 484 bp, Homo sapiens; identical to SEQ ID NO: 535240
  misc_feature: HIJSMM301AP3Y5.47.60.F05.1.454.light.4.raw

SEQ ID NO: 559621 - DNA, 507 bp, Homo sapiens; identical to SEQ ID NO: 559118
  misc_feature: HIJSMM301BTYOX.17.87.H10.1.454.light.4.raw

SEQ ID NO: 559622 - DNA, 488 bp, Homo sapiens
  misc_feature: HIJSMM301ARRDW.43.53.E09.1.454.light.4.raw
tgtgagtagtcacgaccggtgctcgatttagagagagtgtgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctcccccctacaatttcggtcaggggaccaagttgaacatcaatcgaactgtggctgcaccat

SEQ ID NO: 559623 - DNA, 504 bp, Homo sapiens; identical to SEQ ID NO: 535128
  misc_feature: HIJSMM301AQD7R.19.85.H08.1.454.light.4.raw

SEQ ID NO: 559624 - DNA, 508 bp, Homo sapiens; identical to SEQ ID NO: 537871
  misc_feature: HIJSMM301CWNHP.8.33.C11.1.454.light.4.raw

SEQ ID NO: 559625 - DNA, 482 bp, Homo sapiens
  misc_feature: HIJSMM301EOIE6.52.77.G11.1.454.light.4.raw
cgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatcctccctgtctgcatctgtaggagacagagtcaccatcacttgccaggcgagtcaggacattagcaactatttaaattggtatcagctgaaacccgggaaagcccctaagctcctgatcctcgatgcattcactttggaaacaggggtcccatcaaggttcagtgggagtggctctgggacagattttactttcaccatcagcagcctgcagcctgaggatattgcaacatattactgtcaacagtacgataatctcccgctcactttcggcggggggaccaaggtggagatcaaacgaactgtggctgcacc

SEQ ID NO: 559626 - DNA, 488 bp, Homo sapiens; identical to SEQ ID NO: 540342
  misc_feature: HIJSMM301ASM9Q.43.33.C11.1.454.light.4.raw

SEQ ID NO: 559627 - DNA, 508 bp, Homo sapiens
  misc_feature: HIJSMM301COWCL.41.26.C04.1.454.light.4.raw
tctatactatcacgaccggtgctcgatttagtctagcgactttgggtttggggctgggcctcaggaagcagcatcggaggtgcctcagccatggcgtggatccctctcttcctcggcgtccttgcttcctgcacagtttccgtggcctcctcggaattgactcaggcaccctcagtgtccgtgtctccaggacagacagccagaatcacctgctctggagacacgttgggggagacatttgcttcctggtatcaacagaggccaggccagtcccctatcctggtcatctttcaggatgacaaacggccctctggcatccctgaacgcttctctggttccaggtcaggaaacagagccactctaaccatcaccgagacccaggctgtcgatgaggctgactattactgtcaggcctgggacagaaacactggcatattcggcggagggaccaagctgaccgtcctacgtcagcccaaggctgccccctcggtcactctgttcccgccct

SEQ ID NO: 559628 - DNA, 506 bp, Homo sapiens
  misc_feature: HIJSMM301B2J3X.9.12.B01.1.454.light.4.raw
tgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggtccgaacgggaaccgaaggtaggtaaagtacgtaaaacgaaacctagtggg

SEQ ID NO: 559629 - DNA, 505 bp, Homo sapiens; identical to SEQ ID NO: 535503
  misc_feature: HIJSMM301CM87W.8.28.C06.1.454.light.4.raw

SEQ ID NO: 559630 - DNA, 447 bp, Homo sapiens; identical to SEQ ID NO: 535201
  misc_feature: HIJSMM301CCMFS.18.9.A09.1.454.light.4.raw

SEQ ID NO: 559631 - DNA, 484 bp, Homo sapiens
  misc_feature: HIJSMM301BBDBE.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactacccctctcactttcggcgggggaccgaaggtggagatcaaacgaactgtggctgcaccta

SEQ ID NO: 559632 - DNA, 494 bp, Homo sapiens; identical to SEQ ID NO: 535276
  misc_feature: HIJSMM301CVKEP.16.6.A06.1.454.light.4.raw

SEQ ID NO: 559633 - DNA, 486 bp, Homo sapiens
  misc_feature: HIJSMM301AU5FE.10.1.A01.1.454.light.4.raw
catagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagctcctctccgacaggaataacatccggccctcagggatctcagagagattctctgcatccaggtcaggaagcacagcctccctgaccattactggactccaggctgacgacgaagctgattattactgctcagcatgggacaccggcctccagtgcgtgggttttcggcggagggaccaagctgaccgtcctaggtcagaccccg

SEQ ID NO: 559634 - DNA, 479 bp, Homo sapiens; identical to SEQ ID NO: 538204
  misc_feature: HIJSMM301ATNRA.51.60.F05.1.454.light.4.raw

SEQ ID NO: 559635 - DNA, 520 bp, Homo sapiens
  misc_feature: HIJSMM301E2WEG.49.26.C04.1.454.light.4.raw
agtcgagagacacgaccggtgctcgatttagtctagcgactttgggtttgggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgccaaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcacagaggaatattcggcggagggaccaagctgaccgtcctaggtcagcccaaggctgccccctcggtcactctgttcccgccctcctct

SEQ ID NO: 559636 - DNA, 494 bp, Homo sapiens
  misc_feature: HIJSMM301CA3LJ.49.66.F11.1.454.light.4.raw
agtcgagagacacgaccggtgctcgatttagtcacgcgagaaaggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccgagccaggttcagtggcagtgggtttgggacagacttcacgctcaccatcagcagcctagagcctgaagattttgcagtttattactgtcaacagcgtaccacaggattcactttcggccctgggaccagagtggatatcaaacgaactgtggctgcaccatctgtcttcatcttcccg

SEQ ID NO: 559637 - DNA, 490 bp, Homo sapiens; identical to SEQ ID NO: 535526
  misc_feature: HIJSMM301B6V63.26.78.H01.1.454.light.4.raw

SEQ ID NO: 559638 - DNA, 494 bp, Homo sapiens; identical to SEQ ID NO: 534992
  misc_feature: HIJSMM301EBHYC.9.1.A01.1.454.light.4.raw

SEQ ID NO: 559639 - DNA, 492 bp, Homo sapiens; identical to SEQ ID NO: 549170
  misc_feature: HIJSMM301AO6PM.40.81.H04.1.454.light.4.raw

SEQ ID NO: 559640 - DNA, 509 bp, Homo sapiens
  misc_feature: HIJSMM301CUDF4.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactgtggctgcaccatctgtcttcatcttcccg

SEQ ID NO: 559641 - DNA, 489 bp, Homo sapiens; identical to SEQ ID NO: 535139
  misc_feature: HIJSMM301B5MYO.14.55.E11.1.454.light.4.raw

SEQ ID NO: 559642 - DNA, 494 bp, Homo sapiens
  misc_feature: HIJSMM301EUB6D.43.72.G06.1.454.light.4.raw
tgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtggccgcctatgagttgactcagccaccctcagtgtccgtgtccccaggacagacagccagcatcacctgctctggagataaattgggggataaatatgcctcctggtatcagcagaagccaggcgagtcccctgtgttggtcatctatcaagatgacaaacggccctcagggatccctgagcgattctctggctccaactctgggaacacagccactctgaccatcagcgggacccaggctatggatgaggctgacttttactgtcaggcgtgggacaccaacactgtggtttcggcggagggaccaagctgaccgtcctaggtcagcccaaggctcgccccctcggtcta

SEQ ID NO: 559643 - DNA, 494 bp, Homo sapiens
  misc_feature: HIJSMM301AVT23.27.78.H01.1.454.light.4.raw
agcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaactgtggctgcaccatctgt

SEQ ID NO: 559644 - DNA, 507 bp, Homo sapiens; identical to SEQ ID NO: 541461
  misc_feature: HIJSMM301DKVYH.11.57.F02.1.454.light.4.raw

SEQ ID NO: 559645 - DNA, 490 bp, Homo sapiens
  misc_feature: HIJSMM301CX5WQ.27.78.H01.1.454.light.4.raw
  modified_base (458)..(458): a, c, t, g, unknown or other
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactacttactcaagtgatcaccttcggcaagggcaacactgganattaaacgaactgtggctgcaccatctgtctt

SEQ ID NO: 559646 - DNA, 486 bp, Homo sapiens; identical to SEQ ID NO: 535917
  misc_feature: HIJSMM301B7J4B.3.10.A10.1.454.light.4.raw

SEQ ID NO: 559647 - DNA, 494 bp, Homo sapiens; identical to SEQ ID NO: 535629
  misc_feature: HIJSMM301A38BF.4.27.C05.1.454.light.4.raw

SEQ ID NO: 559648 - DNA, 501 bp, Homo sapiens; identical to SEQ ID NO: 536142
  misc_feature: HIJSMM301DCWNG.15.1.A01.1.454.light.4.raw

SEQ ID NO: 559649 - DNA, 484 bp, Homo sapiens; identical to SEQ ID NO: 535441
  misc_feature: HIJSMM301CDTUK.26.60.F05.1.454.light.4.raw

SEQ ID NO: 559650 - DNA, 484 bp, Homo sapiens
  misc_feature: HIJSMM301ED1S7.4.26.C04.1.454.light.4.raw
agcactgtagcacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaaggtggagatcaaacgaa

SEQ ID NO: 559651 - DNA, 504 bp, Homo sapiens
  misc_feature: HIJSMM301DJBF5.7.71.G05.1.454.light.4.raw
cgtgtctctacacgaccggtgctcgatttagtgtcgtcgcaagagagagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaagtggatatcaaacgaactgtggctgcaccatctgtctt

SEQ ID NO: 559652 - DNA, 509 bp, Homo sapiens; identical to SEQ ID NO: 537131
  misc_feature: HIJSMM301CE005.17.33.C11.1.454.light.4.raw

SEQ ID NO: 559653 - DNA, 484 bp, Homo sapiens; identical to SEQ ID NO: 535400
  misc_feature: HIJSMM301A6RDP.46.26.C04.1.454.light.4.raw

SEQ ID NO: 559654 - DNA, 487 bp, Homo sapiens
  misc_feature: HIJSMM301B8890.47.28.C06.1.454.light.4.raw
agctcacgtacacgaccggtgctcgatttagagctcacgtattgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattactgcatgcaagttctacaaacttcctacacttttggccaggggaccaagctggagatcaaacgaa

SEQ ID NO: 559655 - DNA, 485 bp, Homo sapiens
  misc_feature: HIJSMM301D4AXY.47.78.H01.1.454.light.4.raw
agctcacgtacacgaccggtgctcgatttagtgtgagtagtttgggtttgggaacctatgaacattctgtaggggccactgtcttctccacggtgctcccttcatgcgtgactcagccaccctcagcgtctgggacccccgggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcagcctccctggccatcagtgggctccggtccgaggatgaggctgattattattgtgcaacatgggatagtagcctgagtagtgtggttttcggcggagggaccaagttgaccgtcctaggtcagcccaaggctgccccctcggtcactctgttcccaccctcctctacgtgagct

SEQ ID NO: 559656 - DNA, 503 bp, Homo sapiens
  misc_feature: HIJSMM301EVW75.48.57.F02.1.454.light.4.raw
agtatacatacacgaccggtgctcgatttagctcgatatagttgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcaccatctgtcttcatcttcccg

SEQ ID NO: 559657 - DNA, 490 bp, Homo sapiens; identical to SEQ ID NO: 541407
  misc_feature: HIJSMM301ESB75.14.55.E11.1.454.light.4.raw

SEQ ID NO: 559658 - DNA, 487 bp, Homo sapiens; identical to SEQ ID NO: 549649
  misc_feature: HIJSMM301A1MEP.19.71.G05.1.454.light.4.raw

SEQ ID NO: 559659 - DNA, 490 bp, Homo sapiens
  misc_feature: HIJSMM301BZET1.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttcggccaagggaccgaacggtggaaagtacaaacgaaactgtggcgtgcaccta

SEQ ID NO: 559660 - DNA, 497 bp, Homo sapiens; identical to SEQ ID NO: 538030
  misc_feature: HIJSMM301DROQ5.40.23.C01.1.454.light.4.raw

SEQ ID NO: 559661 - DNA, 491 bp, Homo sapiens; identical to SEQ ID NO: 535194
  misc_feature: HIJSMM301CI1AQ.26.78.H01.1.454.light.4.raw

SEQ ID NO: 559662 - DNA, 481 bp, Homo sapiens
  misc_feature: HIJSMM301CZK82.51.41.D08.1.454.light.4.raw
cgatcgtatacacgaccggtgctcgatttagtcacgcgagaaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagccctaaactcctgatctatgctgcatccagtttgcaaagtgaggtcccatccaggttcagtggcagtggatctgggacagatttcactctcaccatcagtagtctgcaacctgaagattttgcaacttactactgtcaacagagttacggtaccctgctcactttcggcggagggaccaaggtggagatcaaacgaactgtggctgcaca

SEQ ID NO: 559663 - DNA, 486 bp, Homo sapiens
  misc_feature: HIJSMM301EI0TJ.49.37.D04.1.454.light.4.raw
agtcgagagacacgaccggtgctcgatttagtagcatactgttgggtttgggggctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagacgtgaagatgtggcagtgtattactgtcagcaatatcacactgctccgctcactttcggcggagggaccagggtggagatcaaacgtaa

SEQ ID NO: 559664 - DNA, 496 bp, Homo sapiens
  misc_feature: HIJSMM301CRX2I.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccctcggtcactctgttccccacctcctcgagtgcgtct

SEQ ID NO: 559665 - DNA, 501 bp, Homo sapiens; identical to SEQ ID NO: 548094
  misc_feature: HIJSMM301A2QXD.41.45.E01.1.454.light.4.raw

SEQ ID NO: 559666 - DNA, 503 bp, Homo sapiens
  misc_feature: HIJSMM301B8JSB.21.22.B11.1.454.light.4.raw
tcgtcgctcgcacgaccggtgctcgatttagacgacagctcaggggagcttcagctgtggtagagaagacaggactcaggaaaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaatgaccgtcctaggtcagcccaagg

SEQ ID NO: 559667 - DNA, 489 bp, Homo sapiens
  misc_feature: HIJSMM301BGYN7.51.73.G07.1.454.light.4.raw
cgatcgtatacacgaccggtgctcgatttagctctacgctcagggggagtcagtctcagtcaggacacagcatggacatgagggtccccgctcagctcctggggctcctgctactctggctccgaggtgccagatgtgccatccagttgacccagtctccatcctccctgtctgcatctgttggagaagtagtcgccatcacttgccagacaagacagacccttagtacatatttaaactggtatcaacagaagccagggacggccccctaaactcataatctatggtgcctccactttgacaaagtggagtcccgtcaaggttcagtggcactggagctgggacagatttcagtctcgtcatccacggcctgcaacttgaggatgttgcgacttactactgtcaagaggctgccactattcctccgtacactttcggccaggggaccaaggtggagatcagacgaactgtggctgcaccatctgtctt

SEQ ID NO: 559668 - DNA, 494 bp, Homo sapiens; identical to SEQ ID NO: 534992
  misc_feature: HIJSMM301BN2LH.9.1.A01.1.454.light.4.raw

SEQ ID NO: 559669 - DNA, 496 bp, Homo sapiens; identical to SEQ ID NO: 535423
  misc_feature: HIJSMM301BSD45.3.33.C11.1.454.light.4.raw

SEQ ID NO: 559670 - DNA, 501 bp, Homo sapiens; identical to SEQ ID NO: 542520
  misc_feature: HIJSMM301DU0PY.10.43.D10.1.454.light.4.raw

SEQ ID NO: 559671 - DNA, 509 bp, Homo sapiens
  misc_feature: HIJSMM301ARVOY.49.65.F10.1.454.light.4.raw
agtcgagagacacgaccggtgctcgatttagctacgctctaaggggctgggcctaaggaagcagcactggtggtgcctcagccatggcctggaccgttctcctcctcggcctcctctctcactgcacagtctctgtgacctcctatgtgctgtctcagtcaccctcggtgtcagtggccccaggacagacggccaggattacctgtgggggagacaacattggaaataaaggtgtgcactgggtaccagcagatgccaggccaggcccctgtcctggtcgtctttgatgatagcgaccggccctcagggatccctgagcgattctctggctccaactctggggacacggccaccctgaccatcagcagggtcgaagccggggatgaggccgactattactgttcacgtgtgggacagtagtagtgatcatgtggtgttcggcggagggaccaagctgaccgtcctaggtcagcccaaggctgccccctcggtcactctgttcccaccct

SEQ ID NO: 559672 - DNA, 463 bp, Homo sapiens; identical to SEQ ID NO: 535062
  misc_feature: HIJSMM301DCE08.11.73.G07.1.454.light.4.raw

SEQ ID NO: 559673 - DNA, 469 bp, Homo sapiens
  misc_feature: HIJSMM301EUREF.51.1.A01.1.454.light.4.raw
cgatcgtatacacgaccggtgctcgatttagacgtctcatcagggggcaggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctgaattggtatcagcaaaaaccagggaaagcccctaagctcctgatcctcgatgcatccaatttggaaacaggggtcccatcaaggttcagtgcaagtggctctgggacagatttcacttttcaccatcagcagactgcagcctgaagatattgcaacatattactgtcaacagtatgataatctcccgctcactttcggcggagggaccaaggtggggatcaaacgaact

SEQ ID NO: 559674 - DNA, 487 bp, Homo sapiens; identical to SEQ ID NO: 539157
  misc_feature: HIJSMM301C9YKN.26.37.D04.1.454.light.4.raw

SEQ ID NO: 559675 - DNA, 493 bp, Homo sapiens; identical to SEQ ID NO: 535745
  misc_feature: HIJSMM301CXUVM.47.78.H01.1.454.light.4.raw

SEQ ID NO: 559676 - DNA, 447 bp, Homo sapiens; identical to SEQ ID NO: 535201
  misc_feature: HIJSMM301CMNA8.18.9.A09.1.454.light.4.raw

SEQ ID NO: 559677 - DNA, 501 bp, Homo sapiens
  misc_feature: HIJSMM301DG64G.14.23.C01.1.454.light.4.raw
cgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagaagcaacttagcctggtaccagcagaaacctggccaggctcccaggctcctcatctatggtgcatccaccagggccactggtgtcccagccaggttcagtggcagtgggtctgggacagagttcactctcaccatcagcagcctgcagtctgaagattttgcagtttattattgtcagcagtataataactggcctccgtggacgttcggccaagggaccaaggtaggaaatcaaacgaactagtggctgcaccatctgtcttcta

SEQ ID NO: 559678 - DNA, 513 bp, Homo sapiens
  misc_feature: HIJSMM301BF09J.43.59.F04.1.454.light.4.raw
tgtgagtagtcacgaccggtgctcgatttagtacacacacttagggattggggtctggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcgggggcaaagctgccctgacactgtcaggtgtgcagcctgaggacgaggctgactattactgcctgctcatatatggtggcgcgtgggtgttcggcggagggaccaagctgaccgtcctgggtcagcccaaggctgccccctcggtcactctgttcccacct

SEQ ID NO: 559679 - DNA, 502 bp, Homo sapiens; identical to SEQ ID NO: 543913
  misc_feature: HIJSMM301ERQY9.18.26.C04.1.454.light.4.raw

SEQ ID NO: 559680 - DNA, 519 bp, Homo sapiens
  misc_feature: HIJSMM301BEAYG.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccaaggtggcaatcaaaccgaactgtggctgcaccatctgtcttcatcttccccg

SEQ ID NO: 559681 - DNA, 521 bp, Homo sapiens
  misc_feature: HIJSMM301AZEN9.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtctgcccaaggctgccccctcggtcactctgttcccgccct

SEQ ID NO: 559682 - DNA, 488 bp, Homo sapiens
  misc_feature: HIJSMM301BBDEA.22.73.G07.1.454.light.4.raw
acatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagtctggtaccagcagagacctggccaggctcccaggctcctcatctatggtgcttctaccagggccactggtactccccgccaggttcagtgccagtgggtctgggacagagttcactctcaccatcagcagcctgcagtctgaagattttgctactttattactgtcagcaatataatgactggttctcgatcaccttcggccaagggacacgactggagattaaacgaactgtggctgcaccatctgt

SEQ ID NO: 559683 - DNA, 502 bp, Homo sapiens
  misc_feature: HIJSMM301BI4AO.12.53.E09.1.454.light.4.raw
atacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaagctgacgtcctgggtcagcccaaggctgcccctcggtcactctgttcccgcctcctctacgtcgtat

SEQ ID NO: 559684 - DNA, 500 bp, Homo sapiens
  misc_feature: HIJSMM301C6TWH.19.78.H01.1.454.light.4.raw
tactctcgtgcacgaccggtgctcgatttagtgtgagtagtttgggtttgggggctttatttgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggcccaaccccactgtcactctgttcccgccctcctccacgagagta

SEQ ID NO: 559685 - DNA, 516 bp, Homo sapiens
  misc_feature: HIJSMM301DLMSC.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaacggcccccaaactcctcatctataggaataatcagcggccctcaggggtccctgaccgattctctggctccaaggctggcacctcagcctccctggccatcagtgggctccgggtccgaggatgaggctgattattactgtgcagcatgggatgacagcctgagtggtccttgggtgttcggcggagggaccaagctgaccgtcctaagtcagcccaaggctgccccctcggtcactctgttcccaccctcctcg

SEQ ID NO: 559686 - DNA, 494 bp, Homo sapiens; identical to SEQ ID NO: 534994
  misc_feature: HIJSMM301A5R5E.27.78.H01.1.454.light.4.raw

SEQ ID NO: 559687 - DNA, 476 bp, Homo sapiens
  misc_feature: HIJSMM301BRK8P.26.72.G06.1.454.light.4.raw
agactatactcacgaccggtgctcgatttagctacgactgcaagggaaagggtgagatccctcactgtggctcactttcagcggagggaccacggtggagatcacacgtaagtgcactttcctaatgctttttcttataaggttttaagtttggagcgtttttgtgtttgagatgttagctcaggtcaattccaaagagtaccagattctttcaaaagtcagatgagtaagggatagaaaattagttcaccttaaggaacagccaagcgctagccagttaagtgaggcatctcaattgcaaggttttctctgcatcggtcaggttagtgatattaacagcgaaaagagatttttgttaagggaaagtaatgaagttaacactgtggatcaccttcggccaagggacacgactggagattaaacgaactgtggctgcaccatctgtcttcatcttcccgccatctgaagtatagtct

SEQ ID NO: 559688 - DNA, 482 bp, Homo sapiens; identical to SEQ ID NO: 546534
  misc_feature: HIJSMM301CWIM3.51.41.D08.1.454.light.4.raw

SEQ ID NO: 559689 - DNA, 492 bp, Homo sapiens
  misc_feature: HIJSMM301CV98E.16.6.A06.1.454.light.4.raw
tgtactactccacgaccggtgctcgatttagatctactgacagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagcttggtaccagcagaaaccggggcagtctcctaagttgctcatttactgggcgtctacccgggaatccggggtccctgaccgattcagtggcagcgggtctgggacagatttcactctcaccatcagcagcctgcaggttgaagatgtggcagtttatactgtcagcagtattatactactcctctgacgttcggccaagggaccaaggtgagatcaaacgaactgtggctgcaccat

SEQ ID NO: 559690 - DNA, 505 bp, Homo sapiens
  misc_feature: HIJSMM301A207Z.9.71.G05.1.454.light.4.raw
tgatacgtctcacgaccggtgctcgatttagtgtcgtcgcaagagagagggggggggtcgacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttccttctttcaagatattcggcggagggaccaggctgaccgtcctgagtcagcccaaggctgcccccc

SEQ ID NO: 559691 - DNA, 511 bp, Homo sapiens; identical to SEQ ID NO: 537464
  misc_feature: HIJSMM301DWPVS.7.34.D01.1.454.light.4.raw

SEQ ID NO: 559692 - DNA, 416 bp, Homo sapiens; identical to SEQ ID NO: 536892
  misc_feature: HIJSMM301B4HHM.16.46.E02.1.454.light.4.raw

SEQ ID NO: 559693 - DNA, 492 bp, Homo sapiens
  misc_feature: HIJSMM301C6IIX.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtggaggtcaaacggaactgtggctgcaccatctgtcttcatt

SEQ ID NO: 559694 - DNA, 485 bp, Homo sapiens; identical to SEQ ID NO: 535363
  misc_feature: HIJSMM301EEEK5.17.26.C04.1.454.light.4.raw

SEQ ID NO: 559695 - DNA, 493 bp, Homo sapiens
  misc_feature: HIJSMM301AW5GL.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctccgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattactgcatgcaagttctacaaacttcctacacttttggccaggggaccaagctggagatcaaacgaactgtgg

SEQ ID NO: 559696 - DNA, 485 bp, Homo sapiens
  misc_feature: HIJSMM301CQXIJ.3.88.H11.1.454.light.4.raw
agacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccactttgcaaactggggtcccatccaggttcagcggcaggggatctgggacagatttcactctcaccatcagcagcctgcagcctgaagattttgcaacttactattgtcaacaggctaacagtttcctttaatcttcggccaagggacacgactggagattaaacgaactgtggctgcaccta

SEQ ID NO: 559697 - DNA, 498 bp, Homo sapiens
  misc_feature: HIJSMM301CV5ET.12.37.D04.1.454.light.4.raw
  modified_base (464)..(464): a, c, t, g, unknown or other
atacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattcggaaattttttaaattggtttcagcagaaaccagggaaagcccctagactcctgattcacgaggcatccaattcggaaataggggtcccacgaaggttcagtggaggtggagctgggacagattttaccctcaccatcagcagcctgcagcctgaagatcttgcaacatattactgtcaacagtataataatctcccgtacacttttggccaggggaccaagctgganatcaaacgaactgtggctgcaccatctgtcttca

SEQ ID NO: 559698 - DNA, 504 bp, Homo sapiens; identical to SEQ ID NO: 539091
  misc_feature: HIJSMM301BLRNU.8.28.C06.1.454.light.4.raw

SEQ ID NO: 559699 - DNA, 494 bp, Homo sapiens; identical to SEQ ID NO: 534992
  misc_feature: HIJSMM301EP0YG.9.1.A01.1.454.light.4.raw

SEQ ID NO: 559700 - DNA, 521 bp, Homo sapiens; identical to SEQ ID NO: 538715
  misc_feature: HIJSMM301AZOY5.27.23.C01.1.454.light.4.raw

SEQ ID NO: 559701 - DNA, 454 bp, Homo sapiens; identical to SEQ ID NO: 536325
  misc_feature: HIJSMM301ANGN4.19.86.H09.1.454.light.4.raw
  modified_base (436)..(436): a, c, t, g, unknown or other

SEQ ID NO: 559702 - DNA, 513 bp, Homo sapiens
  misc_feature: HIJSMM301D0NA8.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggaggaccaagctgaccgtcttaagtcagcccaaggctgccccctcggtcactctgttcccaccctcct

SEQ ID NO: 559703 - DNA, 444 bp, Homo sapiens; identical to SEQ ID NO: 544367
  misc_feature: HIJSMM301BXBX8.2.76.G10.1.454.light.4.raw

SEQ ID NO: 559704 - DNA, 515 bp, Homo sapiens; identical to SEQ ID NO: 538805
  misc_feature: HIJSMM301C2CPQ.14.19.B08.1.454.light.4.raw

SEQ ID NO: 559705 - DNA, 518 bp, Homo sapiens
  misc_feature: HIJSMM301DSL36.10.26.C04.1.454.light.4.raw
catagtagtgcacgaccggtgctcgattagtctagcgactttgggtttgggggctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccaaggtaggcaatcaaccgaactgtggctgcaccatctgtcttcatcttcccgccta

SEQ ID NO: 559706 - DNA, 496 bp, Homo sapiens
  misc_feature: HIJSMM301D8YMW.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttatattgtcagcaatattatattcctcctcagacgttcggccaaggaccaaggtggaaatcaaacgaactgtggctgcaccta

SEQ ID NO: 559707 - DNA, 447 bp, Homo sapiens; identical to SEQ ID NO: 535882
  misc_feature: HIJSMM301EJLKN.18.9.A09.1.454.light.4.raw
  modified_base (429)..(429): a, c, t, g, unknown or other

SEQ ID NO: 559708 - DNA, 494 bp, Homo sapiens; identical to SEQ ID NO: 539894
  misc_feature: HIJSMM301BZGIR.16.53.E09.1.454.light.4.raw

SEQ ID NO: 559709 - DNA, 489 bp, Homo sapiens; identical to SEQ ID NO: 535139
  misc_feature: HIJSMM301BR1A7.14.55.E11.1.454.light.4.raw

SEQ ID NO: 559710 - DNA, 488 bp, Homo sapiens
  misc_feature: HIJSMM301A2MZO.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacaggctgcccccaaccttcggccacggggacgacgactggagattaaacgaaactgtggctgcaccatctgt

SEQ ID NO: 559711 - DNA, 473 bp, Homo sapiens
  misc_feature: HIJSMM301C1U9S.4.54.E10.1.454.light.4.raw
agcactgtagcacgaccggtgctcgatttagatcgtagcagaacacacaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcagcatcacttgccgggcaagtcagagcattagctacttttttaagttggtatcagcagacaccagggaaagcccctaagctcctgatctatgctgcttccagtttgcaaagtggggtcccatcaaggttcagtggcagtggatctgggacagatttcactctcactgtcagcagtctgcaatttgaagattttgctaacttactactgtcaacagagtttcagtatcccttggactttcggccaagggaccaaggtggaaatcaaacgaa

SEQ ID NO: 559712 - DNA, 517 bp, Homo sapiens; identical to SEQ ID NO: 537838
  misc_feature: HIJSMM301DB05K.7.86.H09.1.454.light.4.raw

SEQ ID NO: 559713 - DNA, 514 bp, Homo sapiens
  misc_feature: HIJSMM301BQRM3.8.23.C01.1.454.light.4.raw
ctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtggggggttcaatattggaggtaacaatgtgcactggtaccagcagaaggcagggcaggcccctgtactggtcatctatgggggatccatccggccaggtgggacccctgcgcgattctctgcctccatctcggggaacgcggccaccctgaccatcagcaaagcccaagccggtgatgaggctgactatttttgtcaggtgtgggacagcagcatttatgtcttcggacctgggaccaaggtcaccgtcctaggtcagcccaaggccaaccccactgtcactctgttcccgccctcctcga

SEQ ID NO: 559714 - DNA, 486 bp, Homo sapiens
  misc_feature: HIJSMM301BRN58.49.38.D05.1.454.light.4.raw
agtcgagagacacgaccggtgctcgatttagtatctgatagttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagactttgagagggcctcagggacccctgagcgattctctggctccagctcagcgacaacagtcacgttgaccatcagtggagtccgggcagaggacgaggctgactattactgtcagtcatcagacagtagtggcacttctgtcgtattcggcggagggaccaagctgaccgtcctaggtcagcccaaggctcg

SEQ ID NO: 559715 - DNA, 488 bp, Homo sapiens; identical to SEQ ID NO: 536861
  misc_feature: HIJSMM301B5FQK.12.88.H11.1.454.light.4.raw

SEQ ID NO: 559716 - DNA, 508 bp, Homo sapiens; identical to SEQ ID NO: 536062
  misc_feature: HIJSMM301DUL3H.11.57.F02.1.454.light.4.raw

SEQ ID NO: 559717 - DNA, 491 bp, Homo sapiens; identical to SEQ ID NO: 540256
  misc_feature: HIJSMM301CGBBT.46.67.G01.1.454.light.4.raw

SEQ ID NO: 559718 - DNA, 475 bp, Homo sapiens
  misc_feature: HIJSMM301ENYY5.13.4.A04.1.454.light.4.raw
tcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacaggggtcccatcaaggttcagtggaagtggatctgggacagattttactttcaccatcagcagcctgcagcctgaagatattgcaacatattactgtcagcagtatgataatctcccgatcaccttcggccaaggacacgactggagattaaacgaactgtggctgcacca

SEQ ID NO: 559719 - DNA, 491 bp, Homo sapiens
  misc_feature: HIJSMM301AG106.21.65.F10.1.454.light.4.raw
tcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaaacctggccagcctcccaggctcctcatctatggtgcatccgccagggccactggaatcccagccaggttcagtggcactgggtctgggacagagttcactctcaccatcagcagcctgcagtctgaagattttgaagtttatttctgtctgcagtacaatcagtggcctcggacgttcggccaagggaccaaggtggaaatcaaacgaactagtggctgcaccatctgtcttcta

SEQ ID NO: 559720 - DNA, 506 bp, Homo sapiens
  misc_feature: HIJSMM301ANXNT.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctcggtcactctgttccccaccctcctcg

SEQ ID NO: 559721 - DNA, 456 bp, Homo sapiens
  misc_feature: HIJSMM301BSENX.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctcgccccctcggtcactctcgttcccgccctcctccacgagagta

SEQ ID NO: 559722 - DNA, 445 bp, Homo sapiens; identical to SEQ ID NO: 551845
  misc_feature: HIJSMM301B0G4U.5.9.A09.1.454.light.4.raw

SEQ ID NO: 559723 - DNA, 506 bp, Homo sapiens
  misc_feature: HIJSMM301C8SLG.43.59.F04.1.454.light.4.raw
tgtgagtagtcacgaccggtgctcgatttagtacacacactttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaagcccccaaactcttgatttatgatgtcacttatcggccctcaggggtttcttatcgcttctctggctccaagtctggcaacacggcctcctgacaatctctgggctccaggctgaggacgaggctgattattattgctgctcatatgcaggtagttacacttatgtcttcggaattgggacgacggtcaccgtcctaggtcagcccaaggccaaccccactgtcactctgtt

SEQ ID NO: 559724 - DNA, 482 bp, Homo sapiens; identical to SEQ ID NO: 535352
  misc_feature: HIJSMM301CE2CE.16.81.H04.1.454.light.4.raw

SEQ ID NO: 559725 - DNA, 485 bp, Homo sapiens; identical to SEQ ID NO: 539041
  misc_feature: HIJSMM301AIIN5.46.26.C04.1.454.light.4.raw

SEQ ID NO: 559726 - DNA, 501 bp, Homo sapiens
  misc_feature: HIJSMM301EMNGM.2.49.E05.1.454.light.4.raw
acgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccgggcagagggtcaccatctcttgttctggaagcatgtccaacatcggaagtgataatgtatactggtaccagcagttcccaagagcggcccccaagctcctcatctatagaaattatgaacggtcctcaggggtccctgaccgattctctggctccaagtctggcacctcagcctccctggccatcagtgggctccggtccgaggatgaggctgatttattactgtgttggatgggacagcagcctgagtgcttatgtcttcggaactgggaccacggtcaccgtcctaggt

SEQ ID NO: 559727 - DNA, 489 bp, Homo sapiens; identical to SEQ ID NO: 535386
  misc_feature: HIJSMM301CJDHB.12.51.E07.1.454.light.4.raw

SEQ ID NO: 559728 - DNA, 490 bp, Homo sapiens; identical to SEQ ID NO: 551475
  misc_feature: HIJSMM301A3I6K.51.71.G05.1.454.light.4.raw

SEQ ID NO: 559729 - DNA, 514 bp, Homo sapiens; identical to SEQ ID NO: 538541
  misc_feature: HIJSMM301ERPVB.47.23.C01.1.454.light.4.raw

SEQ ID NO: 559730 - DNA, 484 bp, Homo sapiens
  misc_feature: HIJSMM301EUNTS.11.76.G10.1.454.light.4.raw
cgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaacagaagccaggccagcctccaaagcagctcatttattgggcatctactcgggattccggggtccctgaccgattccgtggcagtggatctgggacaaatttcactctcaccatcaatagcctgcaggctgaagatgtggcagcttattattgtcagcaatattatacttctcttccgatcacttttggccaggggaccaggctggagatcagacgaactgtggt

SEQ ID NO: 559731 - DNA, 486 bp, Homo sapiens
  misc_feature: HIJSMM301CSN6M.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtccatcaaggttcagtggcgccggatctgggacagaattcactctcaccatcagcgggctccagtctgaggactctgcaacttattactgccaacaatatgatatttattctccagcgttcggccaggggaccaaggtggaagtcaagcgaactgtgctgcaccatctgt

SEQ ID NO: 559732 - DNA, 485 bp, Homo sapiens; identical to SEQ ID NO: 535880
  misc_feature: HIJSMM301EO0WC.7.75.G09.1.454.light.4.raw

SEQ ID NO: 559733 - DNA, 502 bp, Homo sapiens; identical to SEQ ID NO: 536253
  misc_feature: HIJSMM301EL6CF.21.22.B11.1.454.light.4.raw

SEQ ID NO: 559734 - DNA, 484 bp, Homo sapiens; identical to SEQ ID NO: 535240
  misc_feature: HIJSMM301AR8ZW.47.60.F05.1.454.light.4.raw

SEQ ID NO: 559735 - DNA, 496 bp, Homo sapiens
  misc_feature: HIJSMM301B4L1S.13.38.D05.1.454.light.4.raw
tcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtggagatcaaacgaactgt

SEQ ID NO: 559736 - DNA, 498 bp, Homo sapiens; identical to SEQ ID NO: 535295
  misc_feature: HIJSMM301EE9WQ.15.25.C03.1.454.light.4.raw

SEQ ID NO: 559737 - DNA, 495 bp, Homo sapiens; identical to SEQ ID NO: 538651
  misc_feature: HIJSMM301A3H5U.10.79.H02.1.454.light.4.raw

SEQ ID NO: 559738 - DNA, 515 bp, Homo sapiens
  misc_feature: HIJSMM301AZQZW.43.23.C01.1.454.light.4.raw
tgtgagtagtcacgaccggtgctcgatttagtacacgtgattagggattggggggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcggggcaaagctgccctgacactgtcaggtgtgcagcctgaggacgaggctgactattactgcctgctcatatatggtggcgcgtgggtgttcggcggagggaccaagctgaccgtcctgggtcagcccaaggctgccccctcggtcactctgttcccaccctcctca

SEQ ID NO: 559739 - DNA, 502 bp, Homo sapiens
  misc_feature: HIJSMM301EMRA6.43.29.C07.1.454.light.4.raw
tgtgagtagtcacgaccggtgctcgatttagagtgctacgaagggaaaggggagcttcagctgtggtagagaagacaggattcaggacaatctccagcatggccggcttccctctcctcctcaccctcctcactcactgtgcagggtcctgggcccagtctgtgctgactcagtcaccctcagcgtctgggacccccgggcagagggtcaccatctcttgttctggaagcagctccaacatcggaagtaattatgtatattggtaccagcagctcccaagaacggcccccaaattcctcatctataggaataatcagcggccctcaggggtccctgaccgattctctggctccaagtctggcacctcagcctccctggccatcagtgggctccggtccgaggatgaggctgattattactgtgcagcatgggatgacagcctgagtggtgtggtattcggcggagggaccaagctgaccgtcctaggtcagcccaaggctcg

SEQ ID NO: 559740 - DNA, 483 bp, Homo sapiens; identical to SEQ ID NO: 535675
  misc_feature: HIJSMM301A1ZZW.41.35.D02.1.454.light.4.raw

SEQ ID NO: 559741 - DNA, 484 bp, Homo sapiens
  misc_feature: HIJSMM301DEV29.17.34.D01.1.454.light.4.raw
cgtagactagcacgaccggtgctcgatttagatcgtctgtgttgggtttggggtgatcaggacttctcagttcatcttctcaccatgaggctccctgctcagctcctggggctgctaatgctctggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttcctccgacgttcgccaaggaccaaggtggaactcaacgaa

SEQ ID NO: 559742 - DNA, 484 bp, Homo sapiens; identical to SEQ ID NO: 537878
  misc_feature: HIJSMM301CPLE2.17.34.D01.1.454.light.4.raw

SEQ ID NO: 559743 - DNA, 520 bp, Homo sapiens
  misc_feature: HIJSMM301ASXLB.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgtcccgccct

SEQ ID NO: 559744 - DNA, 518 bp, Homo sapiens; identical to SEQ ID NO: 539372
  misc_feature: HIJSMM301EV33L.7.86.H09.1.454.light.4.raw

SEQ ID NO: 559745 - DNA, 490 bp, Homo sapiens
  misc_feature: HIJSMM301EC2HD.14.5.A05.1.454.light.4.raw
cgtctagtaccacgaccggtgctcgatttagatagatagacaggggggactgctcagttaggacccagagggaaccatggaagccccagctcagcttctcttcctcctgctactctggctcccagataccaccggagaaattgtgttgacacagtctccaggcaccctgtccttgtctccaggggaaagagccaccctctcctgcagggccagtcagagtgttgatacgtacttagcctggtaccaacagaaacctggccaggctcccaggctcctcatctatgatgcatccatcagggccactggcatcccagccaggttcagtggcagtgggtctgggacagacttcactctcaccatcagcagcctagagcctgaagattttgcagtttattactgtcagcagcgtaccaactggcctcctgcgctcactttcggcggagggaccaaggtggagatcaaacgaactgtggctgcaccatctgtcttc

SEQ ID NO: 559746 - DNA, 494 bp, Homo sapiens
  misc_feature: HIJSMM301DHCS0.10.20.B09.1.454.light.4.raw
catagtagtgcacgaccggtgctcgatttagtgtagtgtgaagggggaggaactgctcagttaggacccagacggaaccatggaagccccagcgcagtttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagcggcctgcagtctgaagattttgcagtttattactgtcagcagtataatgactgggttttattctactttcggccctgggaccaaagtggatttcagacgaactgtggctgcaccatctgtcttcatt

SEQ ID NO: 559747 - DNA, 486 bp, Homo sapiens
  misc_feature: HIJSMM301C92OW.13.46.E02.1.454.light.4.raw
tcacgtactacacgaccggtgctcgatttagactcatctacagggaaaggggtgatcgggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatcagcagggtggaggctgaggatgttattgggctctattattgcatgcaagcaacacactggccgtacacttttggccaggggaccaagctggagatcaatcgaa

SEQ ID NO: 559748 - DNA, 500 bp, Homo sapiens
  misc_feature: HIJSMM301BSSP9.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataaagagttacttagcttggttccagcagaaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttatattgtcagcaaatattatatttcctcctcagacgttcggccaagggaccaaggtggaaatcaaacgaactgtggctgcacca

SEQ ID NO: 559749 - DNA, 490 bp, Homo sapiens
  misc_feature: HIJSMM301EB3H6.11.12.B01.1.454.light.4.raw
  modified_base (208)..(208): a, c, t, g, unknown or other
cgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatgtccgtgtcccccgganagacagccaccatcagctgctctggagatgtcttgactaatgagtatgcttcctggtatcagcagaaggcaggccagccccctgtcctactcatctttcaaaataccaggcggccctctggggtccctgagcgattctccggctccggctctgggaacacagtcactctgaccatcagcgggacccaggctattgatgaggctgtctacttctgtcaggcgtgggacaacagcgtggtgttcggcggagggaccagtctgaccgtcttaggtcagcccaagg

SEQ ID NO: 559750 - DNA, 488 bp, Homo sapiens; identical to SEQ ID NO: 545472
  misc_feature: HIJSMM301AIU2M.4.27.C05.1.454.light.4.raw

SEQ ID NO: 559751 - DNA, 496 bp, Homo sapiens
  misc_feature: HIJSMM301CA8RU.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaaagtgtggctgcaccatctgtcttctatcttccccg

SEQ ID NO: 559752 - DNA, 502 bp, Homo sapiens
  misc_feature: HIJSMM301CK0JH.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcggagggaccaagctgaccgtcctgggtcagcccaaggctgccccctggtca

SEQ ID NO: 559753 - DNA, 502 bp, Homo sapiens; identical to SEQ ID NO: 543936
  misc_feature: HIJSMM301DYL5X.15.1.A01.1.454.light.4.raw

SEQ ID NO: 559754 - DNA, 486 bp, Homo sapiens; identical to SEQ ID NO: 535043
  misc_feature: HIJSMM301AYKZ6.46.35.D02.1.454.light.4.raw

SEQ ID NO: 559755 - DNA, 490 bp, Homo sapiens; identical to SEQ ID NO: 535936
  misc_feature: HIJSMM301AFB0Y.16.68.G02.1.454.light.4.raw

SEQ ID NO: 559756 - DNA, 496 bp, Homo sapiens
  misc_feature: HIJSMM301CULYH.19.57.F02.1.454.light.4.raw
tactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtcggggtcccctcaaggttcagcggcagtggatcgtgggacagatttcactctcgccatcagcagcctgcagactgaagattttgctaacttatttttgtcaacaggctaacacctttccccctctactttcggcggagggaccaaggtggagatcaagcgaactgtggctgcaccatctgtctt

SEQ ID NO: 559757 - DNA, 513 bp, Homo sapiens; identical to SEQ ID NO: 543313
  misc_feature: HIJSMM301AODBX.22.36.D03.1.454.light.4.raw

SEQ ID NO: 559758 - DNA, 482 bp, Homo sapiens
  misc_feature: HIJSMM301BKA6Y.5.39.D06.1.454.light.4.raw
atcagacacgcacgaccggtgctcgatttagtgacatctcgcagttctttggggggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccaggagaggccccaaagctccttatttatgatgcctccactttgattagtggggtcccaccaacgttcagcggcagtggatctgggacagagttcactctcaccatcagcagcctgcagcctgatgatcttggaacttattactgccaacaatataatagttattggacgttggccaggggaccaaggtcgaaatgagacgaactgtggctgcaccat

SEQ ID NO: 559759 - DNA, 444 bp, Homo sapiens; identical to SEQ ID NO: 534993
  misc_feature: HIJSMM301ET1US.5.9.A09.1.454.light.4.raw

SEQ ID NO: 559760 - DNA, 480 bp, Homo sapiens
  misc_feature: HIJSMM301AYVG5.8.53.E09.1.454.light.4.raw
ctcgcgtgtccacgaccggtgctcgatttagagagagtgtgttgggtttgggggctctgcttcagctgtgggcacaagaggcagcactcaggacaatctccagcatggcctggtctcctctcctcctcactctcctcgctcactgcacagggtcctgggcccagtctgtactgacgcagccgccctcagtatctggggccccagggcaggagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggacc

SEQ ID NO: 559761 - DNA, 507 bp, Homo sapiens
  misc_feature: HIJSMM301EJPHJ.40.26.C04.1.454.light.4.raw
tctagcgactcacgaccggtgctcgatttagtctagcgactttgggtttgggggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagtctggtaccaacagaaacctggccaggctcccaggctcctcatctatgatgcatccagcagggccactggcatcccagccaggttcagtggcagtgggtctgggacagacttcactctcaccatcagcggcctagagcctgaagactttgcagtttattactgtcagcagcgtaccaactggccgctcactttcggcggagggaccaaggtggagatcaaacgaactgtggctgcaccatctgtcttcatcttccccg

SEQ ID NO: 559762 - DNA, 504 bp, Homo sapiens
  misc_feature: HIJSMM301BL580.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtaggaatacaaacgaactagtggctgcaccatctgtcttcatcttccccg

SEQ ID NO: 559763 - DNA, 460 bp, Homo sapiens; identical to SEQ ID NO: 536053
  misc_feature: HIJSMM301DB6TD.22.28.C06.1.454.light.4.raw

SEQ ID NO: 559764 - DNA, 483 bp, Homo sapiens
  misc_feature: HIJSMM301DELMO.13.36.D03.1.454.light.4.raw
tcacgtactacacgaccggtgctcgatttagctgcgtcacgatctctcttgggggggtcagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggctcccaggctcctcatttatggtgcatccactagggccactggtgtcccagtcaggttcagcggcattgggtctgggacagacttcactctcaccatcagcagcctgcagtctgagatttgcagtctattactgtcagcagtatagttactggagaaccttcggccaagggacacgactggagattaaaggaa

SEQ ID NO: 559765 - DNA, 505 bp, Homo sapiens; identical to SEQ ID NO: 538422
  misc_feature: HIJSMM301C9OJW.19.78.H01.1.454.light.4.raw

SEQ ID NO: 559766 - DNA, 504 bp, Homo sapiens; identical to SEQ ID NO: 535495
  misc_feature: HIJSMM301B1XFL.14.86.H09.1.454.light.4.raw

SEQ ID NO: 559767 - DNA, 470 bp, Homo sapiens
  misc_feature: HIJSMM301DY2N8.4.23.C01.1.454.light.4.raw
agcactgtagcacgaccggtgctcgatttagtacacgtgattagggattggggagtcccaaccaggacacagcatggacatgagggtccctgctcagctcctggggctcctgctgctctggctctcaggtgccagatgtgacatccagatgacccagtctccatcctccctgtctgcttctgtaggagacagagtcaccatcacttgccaggcgagtcaggacattaacaactatttaatttggtatcagcagaaaccaggccatgcccctaggctcctgatctacgatgcatcccatttggaaacaggggtcccatcaaggttcagtggaggtggatatgggacagattttactttcaccatcagcagcctgcagcctgaagatactgcaacatattactgtcaacagtatgataatctgccgctcactttcggcggagggaccaaggtggagatcaagagaactgtgg

SEQ ID NO: 559768 - DNA, 509 bp, Homo sapiens
  misc_feature: HIJSMM301AM36H.43.23.C01.1.454.light.4.raw
tgtgagtagtcacgaccggtgctcgatttagtacacgtgatttgggattgggaacctatgaacattctgtaggggccactgtcttctccacggtgctcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcggggcaaagctgccctgacactgtcaggtgtgcagcctgaggacgaggctgactattactgcctgctcatatatggtggcgcgtgggtgttcggcggagggaccaagctgaccgtcctgggtcagcccc

SEQ ID NO: 559769 - DNA, 481 bp, Homo sapiens
  misc_feature: HIJSMM301DSEJ3.51.80.H03.1.454.light.4.raw
cgatcgtatacacgaccggtgctcgatttagctgtgcgtcgaagggaaaggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagcatttctttagcctggtatcagcaaaaaccagggaaagcccctaagctcctgatctatgctgcatccactttgcaaactggagtcccatcaaggttcagcggcagtggatctgggacagaattcactctcacaatcagcagcctgcagcctgaagattttgcaacttattactgtcaacagcttaatacttatcctcggacgttcggccaaggaccaacggtggaaatacaaacgaactagtggctgcaccat

SEQ ID NO: 559770 - DNA, 497 bp, Homo sapiens; identical to SEQ ID NO: 543371
  misc_feature: HIJSMM301CBGCB.7.59.F04.1.454.light.4.raw

SEQ ID NO: 559771 - DNA, 498 bp, Homo sapiens; identical to SEQ ID NO: 553891
  misc_feature: HIJSMM301CP6ZD.3.33.C11.1.454.light.4.raw

SEQ ID NO: 559772 - DNA, 489 bp, Homo sapiens; identical to SEQ ID NO: 535139
  misc_feature: HIJSMM301BVC3L.14.55.E11.1.454.light.4.raw

SEQ ID NO: 559773 - DNA, 492 bp, Homo sapiens
  misc_feature: HIJSMM301BQHMG.14.55.E11.1.454.light.4.raw
  modified_base (458)..(458): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccatgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcgggacggacgaggaggtagaanacagacggactgtgctagctacactctgtcttcc

SEQ ID NO: 559774 - DNA, 497 bp, Homo sapiens
  misc_feature: HIJSMM301A16E6.10.28.C06.1.454.light.4.raw
catagtagtgcacgaccggtgctcgatttagagctcacgtattgggtttgggggctttgcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagcccccaaactgatgatttatgatgtcagtaatcgaccctcaggggtttctgatcgcttctttgcctccaagtctggcaacacggcctccctgaccatctctgggctccagactgaggacgaggctgattattactgcagctcacatacaagcggcagcggttgggtgttcggcgggggaccacactgaccgtcctaggtcagcccaaggctgcccctcggtcactctgttcccgccctcctccactactatg

SEQ ID NO: 559775 - DNA, 493 bp, Homo sapiens; identical to SEQ ID NO: 551874
  misc_feature: HIJSMM301CFTLE.18.11.A11.1.454.light.4.raw

SEQ ID NO: 559776 - DNA, 493 bp, Homo sapiens; identical to SEQ ID NO: 535745
  misc_feature: HIJSMM301CN0I6.47.78.H01.1.454.light.4.raw

SEQ ID NO: 559777 - DNA, 495 bp, Homo sapiens; identical to SEQ ID NO: 537716
  misc_feature: HIJSMM301A4YHV.22.14.B03.1.454.light.4.raw

SEQ ID NO: 559778 - DNA, 444 bp, Homo sapiens; identical to SEQ ID NO: 534993
  misc_feature: HIJSMM301AJFWN.5.9.A09.1.454.light.4.raw

SEQ ID NO: 559779 - DNA, 515 bp, Homo sapiens
  misc_feature: HIJSMM301DO0WV.41.45.E01.1.454.light.4.raw
tctatactatcacgaccggtgctcgatttagtgagtcagtaagggaaagggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattatgtcaagcagtagacagcagtggtcttatcggtggtggtcgggggaccgggaacgacgtgacgtccgtacgttcgagaccgaaccggacgtcgcccctcccggttccgactt

SEQ ID NO: 559780 - DNA, 493 bp, Homo sapiens
  misc_feature: HIJSMM301C3AAZ.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatatttcgtgctccgtacacttttggccaggggacccaggtggagatcagacgaactgtggctgcaccatctgcttcatcttcccg

SEQ ID NO: 559781 - DNA, 506 bp, Homo sapiens; identical to SEQ ID NO: 534969
  misc_feature: HIJSMM301BG42X.18.37.D04.1.454.light.4.raw

SEQ ID NO: 559782 - DNA, 511 bp, Homo sapiens
  misc_feature: HIJSMM301BE0CX.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccgggggccactttcggccctcgggaccaaacgtggatatcaaacgaactagtggctgcaccatctgtcttcta

SEQ ID NO: 559783 - DNA, 416 bp, Homo sapiens; identical to SEQ ID NO: 545902
  misc_feature: HIJSMM301AGYAH.18.78.H01.1.454.light.4.raw

SEQ ID NO: 559784 - DNA, 482 bp, Homo sapiens
  misc_feature: HIJSMM301A50RV.52.5.A05.1.454.light.4.raw
cgcagtacgacacgaccggtgctcgatttagatagatagacaggggctgggcctcaggaagcagcatcggaggtgcctcagccatggcatggatccctctcttcctcggcgtccttgcttactgcacaggttctgtggcctcctatgacttgactcagccaccctcagtgtccgtgtccccaggacagacagccaccatcacctgctctggacatcgattgggggatatacatgtttcctggtatcagcagaagccaggccagtctcctgttctcctcatctataaagatgtcaagcggccctcagggatccctgagcgattctctggctccaattctggaaatgcagccactctgaccatcagcgggacccagcctatggatgaggctgactattactgtcaggcgtgggacagtaggtttgtgcttttcggcggagggaccaagctgaccgtcctacgtcagcccaaggctgccccctcc

SEQ ID NO: 559785 - DNA, 490 bp, Homo sapiens
  misc_feature: HIJSMM301C6JCO.22.77.G11.1.454.light.4.raw
acatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtctccatcctcccggtctgcatctgttggagaaagaatcaccatcacttgtcgggcaagtcagagcattgatatccttttaaactggtatcatcagagaccagggaaggcccctaagttcctgatccatgatgcatccactctgcagagtggagtcccatccaggttcagtggcagtgggtctgggacagagttcactctcaccatcaacagtctgcagccagaggactttggaacctactattgccaacagacttacacgtacccccccacgtcggcggacggaccgacagtcgacgatacaaacgaacgtagtggcgtgcaccact

SEQ ID NO: 559786 - DNA, 498 bp, Homo sapiens; identical to SEQ ID NO: 536173
  misc_feature: HIJSMM301A816S.12.86.H09.1.454.light.4.raw

SEQ ID NO: 559787 - DNA, 488 bp, Homo sapiens
  misc_feature: HIJSMM301CIWDS.7.85.H08.1.454.light.4.raw
cgtgtctctacacgaccggtgctcgatttagtatcactcagtcgcgggtccaaacagagcttcagcaaacatagtgggaatctgcaccatgccctgggctctgctcctcctgaccctcctcactcactctgcagtgtcagtggtccaggcagggctgactcagccaccctcggtgtccaagggcctgcgacagaccgcaacactcacctgcactgggagcagcaacgatgttggcagggagggagcagcttggctgcagcaacacgagggccaccctcccaaactcctctcctacaggaataacgagcggccctcagggatctcagagagattctctgcatccaggtcaggaaacacagcctccctgacccattactggactccagcctgaggacgaggctgactattactgctcagcatgggacagcggcctcaggacttatgtcttcggaactgggacccacgttaccgtcctaggtcagaccccg

SEQ ID NO: 559788 - DNA, 483 bp, Homo sapiens; identical to SEQ ID NO: 535413
  misc_feature: HIJSMM301CDF6Y.26.78.H01.1.454.light.4.raw

SEQ ID NO: 559789 - DNA, 504 bp, Homo sapiens
  misc_feature: HIJSMM301ERD6W.51.27.C05.1.454.light.4.raw
cgatcgtatacacgaccggtgctcgatttagacgcgatcgaagggtttgggggaggaactgctcagttaggacccagagggaaccatggaagccccagctcagcttctcttcctcctgctactctggctcccagattccaccggagaaattgtgttgacacagtctccaggcaccctgtctttgtctccaggggaaagagccaccctctcctgcagggccagtcagagtgttagtcacttcttagcctggtaccaacacaaacctggccaggctcccaggctcctcatttatgatgcatccaagagggccactggcgtcccagccaggttcagtggcagtgggtctgggacagacttcactctcaccatcagcagcctagagcctgaagattttgcaatttattactgtcagcagcgtagcaattggcctccctcgatcaccttcggccaagggacacgactggagaataaacgaactgtggctgcaccatctgtctcattccc

SEQ ID NO: 559790 - DNA, 489 bp, Homo sapiens; identical to SEQ ID NO: 536013
  misc_feature: HIJSMM301EX2U4.26.23.C01.1.454.light.4.raw

SEQ ID NO: 559791 - DNA, 506 bp, Homo sapiens; identical to SEQ ID NO: 554070
  misc_feature: HIJSMM301BP0XN.15.5.A05.1.454.light.4.raw

SEQ ID NO: 559792 - DNA, 484 bp, Homo sapiens
  misc_feature: HIJSMM301C12DV.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactacccctctcactttcggcgggggaccgaaggtggagatcaaacgaaactgtggctgcacca

SEQ ID NO: 559793 - DNA, 494 bp, Homo sapiens; identical to SEQ ID NO: 534994
  misc_feature: HIJSMM301D4GCA.27.78.H01.1.454.light.4.raw

SEQ ID NO: 559794 - DNA, 488 bp, Homo sapiens; identical to SEQ ID NO: 536851
  misc_feature: HIJSMM301BH4Q5.41.2.A02.1.454.light.4.raw

SEQ ID NO: 559795 - DNA, 444 bp, Homo sapiens; identical to SEQ ID NO: 535411
  misc_feature: HIJSMM301D7GX5.8.73.G07.1.454.light.4.raw

SEQ ID NO: 559796 - DNA, 493 bp, Homo sapiens
  misc_feature: HIJSMM301C4D9A.13.6.A06.1.454.light.4.raw
tcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattgggttctaatcgggcctccggggtccctaacaggttcagtggcagtggatcaggcacagattttacactgaaaatcagcagagtggaggctgaggatgttggggtttattactgcatgcaagctctacaacctctgcggactttcggccctgggaccaaagtggagatcaaacgaactgtggctgcaccatctgtctt

SEQ ID NO: 559797 - DNA, 497 bp, Homo sapiens
  misc_feature: HIJSMM301DO7QB.11.71.G05.1.454.light.4.raw
cgagagataccacgaccggtgctcgatttagtgtcgtcgcaagagagaggggggaactgctcagttaggacccagagggaaccatggaagccccagctcagcttctcttcctcctgctactctggctcccagatagcaccggagaaattgtgttgacacagtctccagccaccctgtctttgtctccaggggaaagagccaccctctcctgcagggccagtcagagtgttaacagctacttagcctggtaccaacagaaacctggccagactcccaggctcctcatctatgatgcatccaacagggccactggcaccccagccaggttcagtggcagtgggtctgggacagacttcactctcaccatcagcagcctagagcctgaggattttgcagtttattactgtcagcagcgtatcgactggatcaccttcggccaagggacacgactggaaattaacgaactgtggctgcaccatctgtcttcatcttccccg

SEQ ID NO: 559798 - DNA, 454 bp, Homo sapiens; identical to SEQ ID NO: 534964
  misc_feature: HIJSMM301A6P9Z.19.86.H09.1.454.light.4.raw

SEQ ID NO: 559799 - DNA, 509 bp, Homo sapiens; identical to SEQ ID NO: 543266
  misc_feature: HIJSMM301A3UZF.17.33.C11.1.454.light.4.raw

SEQ ID NO: 559800 - DNA, 495 bp, Homo sapiens; identical to SEQ ID NO: 547449
  misc_feature: HIJSMM301C7J8Y.52.34.D01.1.454.light.4.raw

SEQ ID NO: 559801 - DNA, 483 bp, Homo sapiens
  misc_feature: HIJSMM301AMWEF.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggggaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggttttggctgttcggcggcgggacaag

SEQ ID NO: 559802 - DNA, 492 bp, Homo sapiens
  misc_feature: HIJSMM301CQN1W.49.12.B01.1.454.light.4.raw
agtcgagagacacgaccggtgctcgatttagtagtgtagattccgcgggggaagctctgcttcagctgtgagcgcagaaggcaggactcgggacaatcttcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaagaattatgtatcgtggtaccagcagttcccaggaacggcccccagactcctcattcatgacaataacaagcgagtcccagagattcctgaccgattctctggctccaagtctggcacctcagccaccctggccatcaccggactccagactggggacgaggccgattattactgcggaacatgggattccagcctgagtggtgtcagggtgttcggcggagggccaagctgaccgtcct

SEQ ID NO: 559803 - DNA, 503 bp, Homo sapiens
  misc_feature: HIJSMM301DAPOK.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccaaactgaccgtcctaggtcagcccaaggcctgccccctc

SEQ ID NO: 559804 - DNA, 516 bp, Homo sapiens
  misc_feature: HIJSMM301DM4Y8.10.26.C04.1.454.light.4.raw
catagtagtgcacgaccggtgctcgattagtctagcgactttgggtttgggggctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctggggacagacttcattctcaccatcaacagactgcagcctgaagatattgcagtttactactgtcagcagtatgttacgtccccgtggacgttcggccaagggaccaaggtggcaatcaaccgaactgtggctgcaccatctgtcttcatcttcccgcc

SEQ ID NO: 559805 - DNA, 508 bp, Homo sapiens; identical to SEQ ID NO: 540739
  misc_feature: HIJSMM301C4X3Z.14.7.A07.1.454.light.4.raw

SEQ ID NO: 559806 - DNA, 485 bp, Homo sapiens; identical to SEQ ID NO: 535606
  misc_feature: HIJSMM301BDT6T.47.46.E02.1.454.light.4.raw

SEQ ID NO: 559807 - DNA, 487 bp, Homo sapiens; identical to SEQ ID NO: 537079
  misc_feature: HIJSMM301EEA4D.14.55.E11.1.454.light.4.raw

SEQ ID NO: 559808 - DNA, 506 bp, Homo sapiens
  misc_feature: HIJSMM301AMKGO.8.28.C06.1.454.light.4.raw
ctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccgaaggtggacctcaaacgaactgtggctgcaccatctgtcttcatcttcccgccc

SEQ ID NO: 559809 - DNA, 511 bp, Homo sapiens; identical to SEQ ID NO: 548439
  misc_feature: HIJSMM301CAJAP.16.46.E02.1.454.light.4.raw

SEQ ID NO: 559810 - DNA, 463 bp, Homo sapiens; identical to SEQ ID NO: 535062
  misc_feature: HIJSMM301AHOUD.11.73.G07.1.454.light.4.raw

SEQ ID NO: 559811 - DNA, 484 bp, Homo sapiens
  misc_feature: HIJSMM301EYBW0.26.78.H01.1.454.light.4.raw
agactatactcacgaccggtgctcgatttagtgtgagtagtttgggtttggggcagagccctggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacaggacttcactctcaccatcagcagcctagagcctgaagattttgcactttattactgtcagcagcgtagcaactggcctctcactttcggcggagggaccagggtggagatcagacgaa

SEQ ID NO: 559812 - DNA, 504 bp, Homo sapiens; identical to SEQ ID NO: 542288
  misc_feature: HIJSMM301DB87X.8.28.C06.1.454.light.4.raw

SEQ ID NO: 559813 - DNA, 492 bp, Homo sapiens
  misc_feature: HIJSMM301AE1TG.49.33.C11.1.454.light.4.raw
agtcgagagacacgaccggtgctcgatttagagtgagctcgttgggtttgggggaactgctcagttaggacccagacggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttaggagcaacttagcctggtatcagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataatgtccgggctccggacactttcggcggagggaccgaaggtggagatcaaacgaactgtggctgcaccatctgtt

SEQ ID NO: 559814 - DNA, 506 bp, Homo sapiens
  misc_feature: HIJSMM301BPVME.40.67.G01.1.454.light.4.raw
tctagcgactcacgaccggtgctcgatttagagtatacatattgggtttggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccagggccactggcgtcccggccaggttcagtggcagtgggtctgggacagccttcactctcaccatcagcagcctggagcccgaagattttgcggtttattactgtcagcagcgtgccgactggccccctcacgttcggcggagggaccaaggtggacatcaaaacgaactgtggctgcaccatctgtcttcatcttcccgcc

SEQ ID NO: 559815 - DNA, 507 bp, Homo sapiens
  misc_feature: HIJSMM301DIF7L.18.11.A11.1.454.light.4.raw
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgaaactgtggctacgaccactatctgttcta

SEQ ID NO: 559816 - DNA, 494 bp, Homo sapiens; identical to SEQ ID NO: 540664
  misc_feature: HIJSMM301DXWFT.47.64.F09.1.454.light.4.raw

SEQ ID NO: 559817 - DNA, 498 bp, Homo sapiens; identical to SEQ ID NO: 552759
  misc_feature: HIJSMM301ECAX2.48.31.C09.1.454.light.4.raw

SEQ ID NO: 559818 - DNA, 480 bp, Homo sapiens
  misc_feature: HIJSMM301ECRK4.52.5.A05.1.454.light.4.raw
cgcagtacgacacgaccggtgctcgatttagatagatagacaggggctgggcctcaggaagcagcatcggaggtgcctcagccatggcatggatccctctcttcctcggcgtccttgcttactgcacaggttctgtggcctcctatgacttgactcagccaccctcagtgtccgtgtccccaggacagacagccaccatcacctgctctggacatcgattgggggatatacatgtttcctggtatcagcagaagccaggccagtctcctgttctcctcatctataagatgtcaagcggccctcagggatccctgagcgattctctggctccaattctggaaatgcagccactctgaccatcagcgggacccagcctatggatgaggctgactattactgtcaggcgtgggacagtaggtttgtgcttttcggcggagggaccaagctgaccgtcctacgtcagcccaaggctgccccctc

SEQ ID NO: 559819 - DNA, 488 bp, Homo sapiens
  misc_feature: HIJSMM301B7ERD.4.34.D01.1.454.light.4.raw
agcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaaacctggccaggctcccaggctcctcatctatggtgcatccaccagggccactggtatcccagccaggttcagtgccagtgggtctgggacagagttcactctcaccatcagcagcctgcagtctgaagtattttgtcggtttattactgtcagcagtatgataactggctgtactacttttggccgaggggaccaagctggaggatcgaggcgaactgtggctgca

SEQ ID NO: 559820 - DNA, 510 bp, Homo sapiens
  misc_feature: HIJSMM301CKQWP.19.59.F04.1.454.light.4.raw
tactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggaagaatttttgtgtcctggtaccagcagctcccaggaacagcccccaaactcctcatttttgacaataataagcgaccctcagggattcctgaccgattctctggctccaagtctggcacgtcagccaccctgggcatcaccggactccagactggggacgaggccgattattactgcggaacatgggatagcagcctgagtactgtgataatcggcggagggaccaagctgaccgtcctaggtcagcccaaggctgccccctcggtcactctgttccc

SEQ ID NO: 559821 - DNA, 454 bp, Homo sapiens; identical to SEQ ID NO: 535005
  misc_feature: HIJSMM301C01EQ.19.86.H09.1.454.light.4.raw

SEQ ID NO: 559822 - DNA, 478 bp, Homo sapiens; identical to SEQ ID NO: 535129
  misc_feature: HIJSMM301DBBZU.11.11.A11.1.454.light.4.raw

SEQ ID NO: 559823 - DNA, 494 bp, Homo sapiens
  misc_feature: HIJSMM301AVMBA.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggacttcggtcggagggaccgaaggtaggaggagctaaacgaaactc

SEQ ID NO: 559824 - DNA, 487 bp, Homo sapiens; identical to SEQ ID NO: 536025
  misc_feature: HIJSMM301EBJCB.17.34.D01.1.454.light.4.raw

SEQ ID NO: 559825 - DNA, 494 bp, Homo sapiens; identical to SEQ ID NO: 534992
  misc_feature: HIJSMM301AVXUI.9.1.A01.1.454.light.4.raw

SEQ ID NO: 559826 - DNA, 497 bp, Homo sapiens; identical to SEQ ID NO: 536371
  misc_feature: HIJSMM301ADHB2.16.78.H01.1.454.light.4.raw

SEQ ID NO: 559827 - DNA, 478 bp, Homo sapiens; identical to SEQ ID NO: 543315
  misc_feature: HIJSMM301AVUTQ.26.72.G06.1.454.light.4.raw

SEQ ID NO: 559828 - DNA, 489 bp, Homo sapiens
  misc_feature: HIJSMM301DHK5G.43.72.G06.1.454.light.4.raw
tgtgagtagtcacgaccggtgctcgatttagctacgactgcaagggaaaggggagagctgctcagttaggacccagagggaaccatggaaaccccagcgcagcttctcttcctcctgctactctggctcccagatgccaccggagcaattgtgttgacgcagtctccaggcaccctgtctttgtctccaggagaaacagccaccctctcctgccgggccagtcagagtgttagagaagactacttagcctggtaccagcaaaaacctggccaggctcccaggctcctcatcaatggtgcatccagtagggccactggcatcccagacaggttcagtggcagtgggtctgcgacagacttcactctcattatcagcagactggagcctgaggactttgcagtgtatttctgtcaacaatatggtagctcaccgtacacttttggccaggggaccaagctagaaatcaaacgaactgtggctgcaccatct

SEQ ID NO: 559829 - DNA, 502 bp, Homo sapiens; identical to SEQ ID NO: 539002
  misc_feature: HIJSMM301AHDAY.18.59.F04.1.454.light.4.raw

SEQ ID NO: 559830 - DNA, 519 bp, Homo sapiens; identical to SEQ ID NO: 544656
  misc_feature: HIJSMM301EJOV1.27.23.C01.1.454.light.4.raw

SEQ ID NO: 559831 - DNA, 502 bp, Homo sapiens
  misc_feature: HIJSMM301C0THR.7.31.C09.1.454.light.4.raw
cgtgtctctacacgaccggtgctcgatttagacgtctcatcaaggaaggaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataagtatgtctcctggtaccaacaacacccaggcaaagcccccaaactcatgatttatgaggtcactaagcggccctcaggggtccctgatcgcttctctggctccaagtctggcaacacggcctccctgaccgtctctgggctccaggctgaagatgaggctgattattactgctgctcatatgcaggccgcaacagtgatctattcggcggagggaccaagctgaccgtcctaggtcagccaaggctgccccctc

SEQ ID NO: 559832 - DNA, 492 bp, Homo sapiens
  misc_feature: HIJSMM301BI9BT.15.28.C06.1.454.light.4.raw
tctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtggggtcccatcaaggttcagcggcagtggatctgggacagaattcagtctcaccatcagcagcctgcagcctgacgattttgcaacttactactgccaagtgcataataatcatttcggcggagggaccaaggtggagatcaaacgaactgtggctgcaccatctgtcttcattttccccg

SEQ ID NO: 559833 - DNA, 501 bp, Homo sapiens; identical to SEQ ID NO: 536867
  misc_feature: HIJSMM301BV6BL.5.86.H09.1.454.light.4.raw

SEQ ID NO: 559834 - DNA, 494 bp, Homo sapiens; identical to SEQ ID NO: 534992
  misc_feature: HIJSMM301CMH9P.9.1.A01.1.454.light.4.raw

SEQ ID NO: 559835 - DNA, 383 bp, Homo sapiens
  misc_feature: HIJSMM301EJSXU.12.78.H01.1.454.light.4.raw
atacgacgtacacgaccggtgctcgatttagtgtgagtagtttgggtttgggggccgttcctggaagcagctccaacatcggaagtaatactgtaaactggtaccagcagctcccaggaacggcccccaaactcctcatctatagtaataatcagcgaccctcaggggtccctgaccgattctctggctccaagtctggcacctcagcctccctggccatcagtgggctccagtctgaggatgaggctgattattactgtgcatcatgggctgacaccctgactggtccgggagtgttcggcggagggaccaagctgaccgtcctaggtcagcccaaggcagccccctcggtcactctgttcccaccctcctctacgtcgtat

SEQ ID NO: 559836 - DNA, 447 bp, Homo sapiens; identical to SEQ ID NO: 535020
  misc_feature: HIJSMM301DKO62.18.9.A09.1.454.light.4.raw

SEQ ID NO: 559837 - DNA, 502 bp, Homo sapiens; identical to SEQ ID NO: 541971
  misc_feature: HIJSMM301AGC6G.4.39.D06.1.454.light.4.raw

SEQ ID NO: 559838 - DNA, 500 bp, Homo sapiens; identical to SEQ ID NO: 535310
  misc_feature: HIJSMM301B0O20.47.66.F11.1.454.light.4.raw

SEQ ID NO: 559839 - DNA, 491 bp, Homo sapiens
  misc_feature: HIJSMM301AJ2F8.14.5.A05.1.454.light.4.raw
cgtctagtaccacgaccggtgctcgatttagatagatagacaggggggaactgctcagttaggacccagagggaaccatggaagccccagctcagcttctcttcctcctgctactctggctcccagataccaccggagaaattgtgttgacacagtctccaggcaccctgtccttgtctccaggggaaagagccaccctctcctgcagggccagtcagagtgttgatacgtacttagcctggtaccaacagaaacctggccaggctcccaggctcctcatctatgatgcatccatcagggccactggcatcccagccaggttcagtggcagtgggtctgggacagacttcactctcaccatcagcagcctagagcctgaagattttgcagtttattactgtcagcagcgtaccaactggcctcctgcgctcactttcggcggagggaccaaggtggagatcaaacgaactgtggctgcaccatctgtcttc

SEQ ID NO: 559840 - DNA, 494 bp, Homo sapiens; identical to SEQ ID NO: 534992
  misc_feature: HIJSMM301AFBU8.9.1.A01.1.454.light.4.raw

SEQ ID NO: 559841 - DNA, 480 bp, Homo sapiens
  misc_feature: HIJSMM301BLLYL.48.2.A02.1.454.light.4.raw
agtatacatacacgaccggtgctcgatttagactcatctacagggggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagcggcagtggatctggcacagagttcactctcaccatcagcaccctgcagcctgaagattttgcgactttatttctgtctacaagattctaattaccctcggacgttcggccagggaccgaaagtaggagtgtcaaccgaacctgtggctgcacca

SEQ ID NO: 559842 - DNA, 488 bp, Homo sapiens
  misc_feature: HIJSMM301DU5DM.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttacactgtcaacagacttacagtgcccccccgatcaccttcggccaacggacacgactgagattaaacgaaactgtggctgcaccactctgtcttc

SEQ ID NO: 559843 - DNA, 505 bp, Homo sapiens; identical to SEQ ID NO: 536254
  misc_feature: HIJSMM301DGC2A.7.71.G05.1.454.light.4.raw

SEQ ID NO: 559844 - DNA, 473 bp, Homo sapiens; identical to SEQ ID NO: 535262
  misc_feature: HIJSMM301DU75D.8.67.G01.1.454.light.4.raw

SEQ ID NO: 559845 - DNA, 487 bp, Homo sapiens
  misc_feature: HIJSMM301AUBI2.15.49.E05.1.454.light.4.raw
tctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccactggcatcccagccacgttcagtggcagtgggtctgggacagagttcattctcaccatcagcagcctgcagtctgaagatttgcagtttattactgtcagcagtataatgactggcctccgacgttcggccaaggaccgaaggtggaaatcaaacgaactgtggctgcaccat

SEQ ID NO: 559846 - DNA, 521 bp, Homo sapiens; identical to SEQ ID NO: 539470
  misc_feature: HIJSMM301CP0NG.27.23.C01.1.454.light.4.raw

SEQ ID NO: 559847 - DNA, 498 bp, Homo sapiens
  misc_feature: HIJSMM301B7XYS.48.28.C06.1.454.light.4.raw
agtatacatacacgaccggtgctcgatttagagctcacgtattgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagtggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaagctgaccgtcctaggtcagcccaaggctcg

SEQ ID NO: 559848 - DNA, 493 bp, Homo sapiens; identical to SEQ ID NO: 538503
  misc_feature: HIJSMM301B91TI.9.1.A01.1.454.light.4.raw

SEQ ID NO: 559849 - DNA, 497 bp, Homo sapiens
  misc_feature: HIJSMM301EURRL.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggagacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtggaaagtcaaacgaactagtggctgcaccatctgtcttctat

SEQ ID NO: 559850 - DNA, 494 bp, Homo sapiens; identical to SEQ ID NO: 549057
  misc_feature: HIJSMM301BI0RV.10.33.C11.1.454.light.4.raw

SEQ ID NO: 559851 - DNA, 496 bp, Homo sapiens
  misc_feature: HIJSMM301BOCCW.48.59.F04.1.454.light.4.raw
agtatacatacacgaccggtgctcgatttagtacacacacttagggattgggggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagatttgcagtgtattactgtcagcagtatggtagctcaccgatcaccttcggccaagggacacgactggagattaaccgaactgtggctgcaccatctgtcttcatctttcccgccatctgatatgtatact

SEQ ID NO: 559852 - DNA, 473 bp, Homo sapiens
  misc_feature: HIJSMM301CM5Q3.3.38.D05.1.454.light.4.raw
agacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtgggtcccatcaaggttcagtggcagtggatctgggacagatttcactctcaccatcaacagtctgcaacctgaagattttgcaacttactactgtcaacagagtttcactacccctctcactttcggcggggggaccgaaggtggagatcaaacgaa

SEQ ID NO: 559853 - DNA, 507 bp, Homo sapiens
  misc_feature: HIJSMM301CSKY4.2.21.B10.1.454.light.4.raw
acgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaggacaggcccctgtaattgtcatctatggaatctatggtaaaaacaaccggccctcagggatcccagaccgattctctggctcctactcaggaaacacagcttccttgaccatcactggggctcaggcggaagatgaggctgactattattgtaagtccgggacagaagtggtaattacatggtgttcggcggagggaccaagctgaccgtcctacgtcagcccaaggctgccccctcggtcactctcg

SEQ ID NO: 559854 - DNA, 516 bp, Homo sapiens; identical to SEQ ID NO: 536108
  misc_feature: HIJSMM301BLQ8T.22.30.C08.1.454.light.4.raw

SEQ ID NO: 559855 - DNA, 455 bp, Homo sapiens
  misc_feature: HIJSMM301D181W.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcgcaaggctcgcccctcggtcactctcgttcccgccctcctccacgagagta

SEQ ID NO: 559856 - DNA, 511 bp, Homo sapiens
  misc_feature: HIJSMM301DRY5C.48.23.C01.1.454.light.4.raw
agtatacatacacgaccggtgctcgatttagtacacgtgattagggattggggagagaagacaggactcaggacaatctccagcatggccagcttccctctcctcctcaccctcctcactcactgtgcagggtcctgggcccagtctgtgctgactcagccaccctcagcgtctgggacccccggtcagagtgtcaccatctcttgttctggaagcggctccaacatcggaagaaatactgtgaactggtaccagcagctcccaggagcggcccccagactctacatctataataattatcgccggccctcaggggtccctgaccgagtctctgcctccaagtctggcacctcagcctccctggccatcagtggcctccggtctgaagaggagggtgattattactgtgcagcgtgggatgacagcctgaatgcttgggtgttcggcggagggaccaagttgaccgtcctaggtcaacccaaggctgccccctcggtccactctgttcccg

SEQ ID NO: 559857 - DNA, 484 bp, Homo sapiens
  misc_feature: HIJSMM301AIVNX.12.8.A08.1.454.light.4.raw
atacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccagcatcacctgctctggagatgtattgactaatgagtatgcttcctggtatcagcagaaggcaggccagccccctgtcctactcatctttcaaaataccaggcggccctctggggtccctgagcgattctctggctccgactctgggaacacagtcactctgaccatcagcgggacccaggctattgatgaggctgtctactactgtcaggcgtgggacagcagcgtggtgttcggcggagggaccagtctgaccgtcttaggtcagcccaaggctgccccctcggtcta

SEQ ID NO: 559858 - DNA, 512 bp, Homo sapiens
  misc_feature: HIJSMM301CV44K.17.33.C11.1.454.light.4.raw
  modified_base (425)..(425): a, c, t, g, unknown or other
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggnggtgctgtgctattcggcggagggaccaagctgaccgtcttaagtcagcccaaggctgccccctcggtcactctgttcccacctcct

SEQ ID NO: 559859 - DNA, 504 bp, Homo sapiens
  misc_feature: HIJSMM301A3PRJ.18.78.H01.1.454.light.4.raw
tacgagtatgcacgaccggtgctcgatttagtgtgagtagtttgggtttgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccatgtca

SEQ ID NO: 559860 - DNA, 470 bp, Homo sapiens; identical to SEQ ID NO: 535009
  misc_feature: HIJSMM301CJIVB.18.76.G10.1.454.light.4.raw

SEQ ID NO: 559861 - DNA, 496 bp, Homo sapiens; identical to SEQ ID NO: 535660
  misc_feature: HIJSMM301EJ5Y0.43.25.C03.1.454.light.4.raw

SEQ ID NO: 559862 - DNA, 454 bp, Homo sapiens; identical to SEQ ID NO: 551323
  misc_feature: HIJSMM301DO594.51.38.D05.1.454.light.4.raw

SEQ ID NO: 559863 - DNA, 510 bp, Homo sapiens
  misc_feature: HIJSMM301ELM1U.13.19.B08.1.454.light.4.raw
tcacgtactacacgaccggtgctcgatttagtgagtcagtaagggggtaggctcaggaggcagagctctgaatgtctcaccatggcctggatccctctcctgctccccctcctcattctctgcacagtctctgtgacctcctatgaactgacacagccatcctcagtgtcagtgtctccgggacagacggccaggatcacctgctcaggaaatattctgacaaaaaatatgctcggtggttccagcagaagccaggccaggccccagtactggtgatttataaagacattgagcggccctcagggatccctgagcgattctccggctctaattcagggaccacagtcaccttgaccatcaccggggcccagattgaggatgaggctgactattattgttactctgcggctgacaaccatctggttttcggcgggggaccaagttgaccgtcgtgggtcgagcccaaggctgccccctcggtcactcctgttcccgccctcctctagtacg

SEQ ID NO: 559864 - DNA, 483 bp, Homo sapiens; identical to SEQ ID NO: 536697
  misc_feature: HIJSMM301B2JZC.46.26.C04.1.454.light.4.raw

SEQ ID NO: 559865 - DNA, 503 bp, Homo sapiens
  misc_feature: HIJSMM301CCEDE.18.78.H01.1.454.light.4.raw
tacgagtatgcacgaccggtgctcgatttagtgtgagtagtttgggtttgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtctaggtcagcccaaggccaacccactgtca

SEQ ID NO: 559866 - DNA, 509 bp, Homo sapiens
  misc_feature: HIJSMM301ENZ9S.5.59.F04.1.454.light.4.raw
atcagacacgcacgaccggtgctcgatttagtacacacacttagggattgggggaagagctgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctgggacagacttcactctcaccatcagcagactggagcctgaagattttgcagtgtattactgtcagcagtatggtagctcacggacgttcggccaagggaccaacggtggaaagtacaaacgaactagtggcgtgcaccatctgtcttcatcttccccg

SEQ ID NO: 559867 - DNA, 491 bp, Homo sapiens
  misc_feature: HIJSMM301CBRAF.13.5.A05.1.454.light.4.raw
tcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcacttcggcggagggaccaaggtggagatcaaacgaactgtggc

SEQ ID NO: 559868 - DNA, 416 bp, Homo sapiens; identical to SEQ ID NO: 545902
  misc_feature: HIJSMM301DSKGB.18.78.H01.1.454.light.4.raw

SEQ ID NO: 559869 - DNA, 494 bp, Homo sapiens; identical to SEQ ID NO: 534992
  misc_feature: HIJSMM301EJPWG.9.1.A01.1.454.light.4.raw

SEQ ID NO: 559870 - DNA, 486 bp, Homo sapiens; identical to SEQ ID NO: 535043
  misc_feature: HIJSMM301D9HMO.46.35.D02.1.454.light.4.raw

SEQ ID NO: 559871 - DNA, 505 bp, Homo sapiens
  misc_feature: HIJSMM301BMR51.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggtccaagggaccaaggtggaaatacaaacgaactagtggctgcaccatctgtcttcatcttccccg

SEQ ID NO: 559872 - DNA, 488 bp, Homo sapiens
  misc_feature: HIJSMM301A1ADY.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtcgtctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattactgcatgcaagttctacaaacttcctacacttttggccaggggaccaagctggagatcaaacgaa

SEQ ID NO: 559873 - DNA, 499 bp, Homo sapiens; identical to SEQ ID NO: 542528
  misc_feature: HIJSMM301CHVAE.52.34.D01.1.454.light.4.raw

SEQ ID NO: 559874 - DNA, 512 bp, Homo sapiens
  misc_feature: HIJSMM301CE60E.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccacgtttcggcccgtcgggaccgaaagtaggatatacaacgaactagtggctgcaccatctgtctt

SEQ ID NO: 559875 - DNA, 494 bp, Homo sapiens; identical to SEQ ID NO: 542264
  misc_feature: HIJSMM301C01F0.13.6.A06.1.454.light.4.raw

SEQ ID NO: 559876 - DNA, 487 bp, Homo sapiens
  misc_feature: HIJSMM301B3EOX.17.25.C03.1.454.light.4.raw
cgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacagatttcaaatctcaccatcaccactctgcaacctgaggattgtgcaatctactactgtcaacagagttacagttcccctcgcacttttggccaggggaccaaagttgagatcaaacgaactgtggctgcaccatctgt

SEQ ID NO: 559877 - DNA, 487 bp, Homo sapiens
  misc_feature: HIJSMM301AMDF3.49.81.H04.1.454.light.4.raw
agtcgagagacacgaccggtgctcgatttagtagtgtagattcgcgggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatctaccaactcactttcggcggagggaccacggtggaggatcaaacgaactagtggctgcaccatctgtcttcta

SEQ ID NO: 559878 - DNA, 510 bp, Homo sapiens; identical to SEQ ID NO: 535855
  misc_feature: HIJSMM301DGRT3.17.33.C11.1.454.light.4.raw

SEQ ID NO: 559879 - DNA, 492 bp, Homo sapiens; identical to SEQ ID NO: 535126
  misc_feature: HIJSMM301EP3N2.18.11.A11.1.454.light.4.raw

SEQ ID NO: 559880 - DNA, 501 bp, Homo sapiens; identical to SEQ ID NO: 546428
  misc_feature: HIJSMM301AOAF1.48.8.A08.1.454.light.4.raw

SEQ ID NO: 559881 - DNA, 509 bp, Homo sapiens
  misc_feature: HIJSMM301EKARX.9.43.D10.1.454.light.4.raw
tgatacgtctcacgaccggtgctcgatttagactagcagtaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcattggtggttatgactatgtctcctggtatcaacaacacccaggcaaagcccccaaactcttgatttatgaggtcagtaggaggccctcaggggtccctgatcgcttctctggctccaagtctgccaaacacggcctccctgaccgtctctgggctccaggctgaggatgaggctgattattattgcagctcatattcaggcagtaacagggttttcggcggagggaccaagctgaccgtcctaggtcagcccaaggctgccccctcggtcactctgttcccgccctcctc

SEQ ID NO: 559882 - DNA, 487 bp, Homo sapiens; identical to SEQ ID NO: 551926
  misc_feature: HIJSMM301CIATR.26.37.D04.1.454.light.4.raw

SEQ ID NO: 559883 - DNA, 476 bp, Homo sapiens
  misc_feature: HIJSMM301C17ZS.52.1.A01.1.454.light.4.raw
cgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtggggtcccatcaaggttcagtggcagtggatctgggacagaattcactctcaccatcaccagtctgcaggctgaggattttgcaacttcttctgtcaacagagttacagttccctcactttcggccctgggaccatagtggatatcaacgaactgtggctgcaccatctgt

SEQ ID NO: 559884 - DNA, 489 bp, Homo sapiens; identical to SEQ ID NO: 536013
  misc_feature: HIJSMM301A8QEP.26.23.C01.1.454.light.4.raw

SEQ ID NO: 559885 - DNA, 460 bp, Homo sapiens; identical to SEQ ID NO: 537107
  misc_feature: HIJSMM301DUV76.22.28.C06.1.454.light.4.raw

SEQ ID NO: 559886 - DNA, 493 bp, Homo sapiens
  misc_feature: HIJSMM301BHFDY.13.6.A06.1.454.light.4.raw
tcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcgggcctccggggtccctaacaggttcagtggcagtggatcaggcacagattttacactgaaaatcagcagagtggaggctgaggatgttggggtttattactgcatgcaagctctacaacctctgcggactttcggccctgggaccaaagtggagatcaacgaactgtggctgcaccatctgtctt

SEQ ID NO: 559887 - DNA, 473 bp, Homo sapiens; identical to SEQ ID NO: 535262
  misc_feature: HIJSMM301AV3XD.8.67.G01.1.454.light.4.raw

SEQ ID NO: 559888 - DNA, 481 bp, Homo sapiens
  misc_feature: HIJSMM301CSD53.4.1.A01.1.454.light.4.raw
agcactgtagcacgaccggtgctcgatttagacgtctcatcagggggaggaactgctcagttaggacccagacggaaccatggaagccccagcgcagcttctcttcctcctgctactctggctcccagaatccgctggagaaatcgtagtgacgcagtctccagccaccctgtctgtgtctccaggggagagagccaccctctcctgcagggccaatcagagtattggtcacagcttagcctggtaccagcagaaacctggccaggctcccggtctcctcatctctgctgcgtccatcagggccactggtatccctgccaggttccgtggcagtgggtctgggacagagttcactctcaccatcagcagcctgcagtctgatgatgttgcagtttattactgtcatcaatatggtgaccggccacgttcggccaagggccaaggtggaaatcaaacgaactgtggctgcaccatctgtctt

SEQ ID NO: 559889 - DNA, 494 bp, Homo sapiens; identical to SEQ ID NO: 535497
  misc_feature: HIJSMM301BDPGP.43.72.G06.1.454.light.4.raw

SEQ ID NO: 559890 - DNA, 500 bp, Homo sapiens
  misc_feature: HIJSMM301C70DP.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaaggtcaccatcacttgccgggcaagtcaggacattagaaatgaattagcctggtttcagcagaaccagggaaagccctaagctcctgatctatgctgcatccactttacaaaatggagtcccatcaagattcagcggcagtggatctggcacagctttcacttctcaccgtcagcagcctgcagtctgaagattttgcaacttattactgtctacaagattcttcttaccctcggacgttcggccgtacgggaccgaaccggtggagtggttcgaagacggaactacgtggccttaggcacctat

SEQ ID NO: 559891 - DNA, 496 bp, Homo sapiens
  misc_feature: HIJSMM301AR1O6.49.66.F11.1.454.light.4.raw
agtcgagagacacgaccggtgctcgatttagtcacgcgagaagggggaggagctgctcagttaggacccagagggaaccatggaagccccagctcagcttctcttcctcctgctactctggctcccagatatcaccggagaaattgtgttgacgcaatctccagccaccctgtctttgtctccaggggagagagcgaccctctcctgcagggccagtcagaatgttgacaactacttggcctggtaccagcagaagcctggccaggcccccggctcctcatctatgatgcttcaaacagggcccctgacaccccagccaggttcagtggcagtgggtctgggactggcttcactcttaccatcagcagtctcgagcctgaagatcttgcaatttatttctgtcaacagcgcagcaagtggcccctcacttttggccaggggaccaagttggagatcagacgaactgtggctgcaccatctgtcttcatcttccccg

SEQ ID NO: 559892 - DNA, 497 bp, Homo sapiens; identical to SEQ ID NO: 536371
  misc_feature: HIJSMM301BWC6E.16.78.H01.1.454.light.4.raw

SEQ ID NO: 559893 - DNA, 489 bp, Homo sapiens; identical to SEQ ID NO: 535386
  misc_feature: HIJSMM301A1498.12.51.E07.1.454.light.4.raw

SEQ ID NO: 559894 - DNA, 499 bp, Homo sapiens; identical to SEQ ID NO: 537739
  misc_feature: HIJSMM301ATEYS.12.86.H09.1.454.light.4.raw

SEQ ID NO: 559895 - DNA, 491 bp, Homo sapiens; identical to SEQ ID NO: 542796
  misc_feature: HIJSMM301C4PRM.19.57.F02.1.454.light.4.raw

SEQ ID NO: 559896 - DNA, 458 bp, Homo sapiens
  misc_feature: HIJSMM301CE8DP.10.86.H09.1.454.light.4.raw
catagtagtgcacgaccggtgctcgatttagtgctatagacttgggtttgggggctgtcccggggaagtgctggtaccaggatacataattcgccctcagtgtctgcggccccaggacagagggtcaccgtctcctgctctggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccagaccggggacgaggccgattattactgcgcaacttgggactccaacctgactgttggggctttcggcggagggactaagttgaccgtcctacgtcagcccaaggctgccccctcggtcactctgttcccaccctcctcactactatg

SEQ ID NO: 559897 - DNA, 443 bp, Homo sapiens
  misc_feature: HIJSMM301DRV02.9.9.A09.1.454.light.4.raw
tgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaacccctcatctatggtaatagtaatcggccctcaggggtccctgaccgattctctggctccaagtctggcacctcagcctccctggccatcactgggcttcaggctgaggatgaggctgattattactgccactcctatgacagcagcctgagaagtgtggtattcggcggagggaccaagctgaccgtcctaggtcagcccaaggctgccccctcggtcactctgttcccacctcctcagacgtatca

SEQ ID NO: 559898 - DNA, 477 bp, Homo sapiens
  misc_feature: HIJSMM301EM2RU.17.34.D01.1.454.light.4.raw
cgtagactagcacgaccggtgctcgatttagatcgtctgtgttgggtttggggtgatcaggacttctcagttcatcttctcaccatgaggctccctgctcagctcctggggctgctaatgctctggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatgagcttctccgacgtcgcaggacaaggtggactcaacgaa

SEQ ID NO: 559899 - DNA, 501 bp, Homo sapiens; identical to SEQ ID NO: 546822
  misc_feature: HIJSMM301AXZ9F.4.39.D06.1.454.light.4.raw

SEQ ID NO: 559900 - DNA, 486 bp, Homo sapiens; identical to SEQ ID NO: 547600
  misc_feature: HIJSMM301EN1F0.3.55.E11.1.454.light.4.raw

SEQ ID NO: 559901 - DNA, 510 bp, Homo sapiens
  misc_feature: HIJSMM301BUH7P.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctggtgctattcggcggagggaccaagctgaccgtcttaagtcagcccaaggctgccccctcggtcactctgttccca

SEQ ID NO: 559902 - DNA, 487 bp, Homo sapiens
  misc_feature: HIJSMM301DQ9LI.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaattactactgtcaacagagttacagtacccccctcactttcggcggagggaccaaggcggagatcagacgaactgtgctgcaccatctgtcttcta

SEQ ID NO: 559903 - DNA, 517 bp, Homo sapiens; identical to SEQ ID NO: 541775
  misc_feature: HIJSMM301ASAQV.5.27.C05.1.454.light.4.raw

SEQ ID NO: 559904 - DNA, 442 bp, Homo sapiens
  misc_feature: HIJSMM301BCFZF.9.9.A09.1.454.light.4.raw
tgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaacccctcatctatggtaatagtaatcggccctcaggggtccctgaccgattctctggctccaagtctggcacctcagcctccctggccatcactgggcttcaggctgaggatgaggctgattattactgccactcctatgacagcagcctgagaagtgtggtattcggcgagggaccaagctgaccgtcctaggtcagcccaaggctgccccctcggtcactctgttcccacctcctcagacgtatca

SEQ ID NO: 559905 - DNA, 504 bp, Homo sapiens
  misc_feature: HIJSMM301CICAF.48.23.C01.1.454.light.4.raw
agtatacatacacgaccggtgctcgatttagtacacgtgattagggagttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcaccatctgtcttcatcttccccg

SEQ ID NO: 559906 - DNA, 513 bp, Homo sapiens; identical to SEQ ID NO: 545469
  misc_feature: HIJSMM301A9K1I.8.23.C01.1.454.light.4.raw

SEQ ID NO: 559907 - DNA, 503 bp, Homo sapiens; identical to SEQ ID NO: 538884
  misc_feature: HIJSMM301C9V8D.27.78.H01.1.454.light.4.raw

SEQ ID NO: 559908 - DNA, 485 bp, Homo sapiens
  misc_feature: HIJSMM301CXRIS.3.88.H11.1.454.light.4.raw
agacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccactttgcaaactggggtcccatccaggttcagcggcaggggatctgggacagatttcactctcaccatcagcagcctgcagcctgaagattttgcaacttactattgtcaacaggctaacagtttcccttaatcttcggccaagggacacgactggagattaaacgaactgtggctgcaccta

SEQ ID NO: 559909 - DNA, 492 bp, Homo sapiens
  misc_feature: HIJSMM301A3ZFZ.3.12.B01.1.454.light.4.raw
agacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggatagagccaccctctcctgcagggccagtcagagtgttgacagcaacttggcctggtaccagcagcaacctggccaggctcccaggctcctcatctatgatgcatccaccagggccaccggtatcccagccaggttcagtggcagtgggtctggggacagagttcactctcaccatcagcagcctgcagtctgaggattttgcagtttattactgtcagcattacaataactggcctcggctcactttcggcggagggaccaaggtggagatcaaacgaactgtggctgcaccatcttcg

SEQ ID NO: 559910 - DNA, 506 bp, Homo sapiens; identical to SEQ ID NO: 539721
  misc_feature: HIJSMM301BI0UO.3.79.H02.1.454.light.4.raw

SEQ ID NO: 559911 - DNA, 502 bp, Homo sapiens
  misc_feature: HIJSMM301E319V.4.59.F04.1.454.light.4.raw
agcactgtagcacgaccggtgctcgatttagtacacacacttagggattgggcacgaccggtgctcgatttagtacacacacttagggattggggaggaactgctcagttaggacccagacggaaccatggaagccccagcgcagcttctcttcctcctgctactctggctcccagataccactggagaaataatattgacgcagtctccagccaccctgtctgtgtctccaggggaaagagccaccctctcctgcagggccagtcagagtgttagcagcaacttagcctggtaccagcagaagcctggccagactcccaggctcctcatctttggtgcattcaccagggccactgatatcccaaccaggttcagcggcagtgggtctgggacagagttcactctcaccatcagcaacctgcagtctgaagattctgcagtttattattgtcaccagtattatagttggcctccgtggacgttcgccgaggaccgaacggta

SEQ ID NO: 559912 - DNA, 483 bp, Homo sapiens; identical to SEQ ID NO: 535413
  misc_feature: HIJSMM301ESJMY.26.78.H01.1.454.light.4.raw

SEQ ID NO: 559913 - DNA, 499 bp, Homo sapiens
  misc_feature: HIJSMM301EEF6T.3.33.C11.1.454.light.4.raw
agacgcactccacgaccggtgctcgatttagagtgagctcgttggggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccccg

SEQ ID NO: 559914 - DNA, 467 bp, Homo sapiens; identical to SEQ ID NO: 538403
  misc_feature: HIJSMM301DB488.41.48.E04.1.454.light.4.raw

SEQ ID NO: 559915 - DNA, 511 bp, Homo sapiens
  misc_feature: HIJSMM301BY2NO.14.3.A03.1.454.light.4.raw
cgtctagtaccacgaccggtgctcgatttagagagcgtcacaggggggggtcgtcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgttctcctggtaccaacagcacccaggcaaagcccccaaacctcattatttatgaggtcaataatcggccctcaggagtttctaatcgcttctctggctccaagtctggcaacacggcctccctgagcatctctgggctccaggctgaggacgaggctgattattactgcagctcatatactattagcagaactgtggttttcggtcggagggaccgaaggtgaccgtcctaggtcagcccaaggctgccccctcggtcactcttcg

SEQ ID NO: 559916 - DNA, 506 bp, Homo sapiens
  misc_feature: HIJSMM301DO1E7.4.10.A10.1.454.light.4.raw
agcactgtagcacgaccggtgctcgatttagcgtcgatctcagggggggtagagaagacaggactcaggacaatctccagcatggccagcttccctctcctcctcaccctcctcactcactgtgcagggtcctgggcccactctgtgctgactcagccaccctcagcgtctgggacccccgggcagagggtcaccatctcttgttctggaagcacctccaacatcggaagtaatcctgtaaactggttccagcaactcccaggaagggcccccaaagtcctcatctatggtcagaatcagcgtccctcaggggtccctgaccgattctctggctccaagtctgacacctcagcctccctggccatcagtgggctccagtctgaggatgaggctgattattactgtgcaacatgggatgacatcctacgtggtgcggtgttcggcggagggaccaagttgaccgtcctggtcagcccaaggctgccccctcggtcactctgttccca

SEQ ID NO: 559917 - DNA, 496 bp, Homo sapiens; identical to SEQ ID NO: 535109
  misc_feature: HIJSMM301CVH37.16.78.H01.1.454.light.4.raw

SEQ ID NO: 559918 - DNA, 501 bp, Homo sapiens
  misc_feature: HIJSMM301DMWVQ.11.31.C09.1.454.light.4.raw
cgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagattattttatacagctccgacagtaagaactacttatcttggttccaacagaaaccaggacagcctcctaaattactcatttattccacatctatgcgggcctccggggtccccgaccgattcagtggcagcggatctgggacagatttcactctcacaatcagcagcctgcagactgaagatgtgggcgtttattattgtcaacaatattctcttgttccgtttaatttcggcggagggaccaaggtggagatcaaacgaactgtggctgcaccatctgtcttcatcttcccgccat

SEQ ID NO: 559919 - DNA, 478 bp, Homo sapiens; identical to SEQ ID NO: 535129
  misc_feature: HIJSMM301EHKVW.11.11.A11.1.454.light.4.raw

SEQ ID NO: 559920 - DNA, 486 bp, Homo sapiens; identical to SEQ ID NO: 537310
  misc_feature: HIJSMM301DTZZ4.15.28.C06.1.454.light.4.raw

SEQ ID NO: 559921 - DNA, 486 bp, Homo sapiens; identical to SEQ ID NO: 535043
  misc_feature: HIJSMM301EUEBT.46.35.D02.1.454.light.4.raw

SEQ ID NO: 559922 - DNA, 480 bp, Homo sapiens
  misc_feature: HIJSMM301C2CFD.13.55.E11.1.454.light.4.raw
tcacgtactacacgaccggtgctcgatttagcactcgcacgttgggtttggggactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtggggtcccatcaaggttcagcggcagtggatctggcacagacttcattcttcaccatcagcagcctgcagcctgaagattttgcaacttattactgtctacaagatcacaattatctggacgttcggccaggacgaaggtgaatacaaacgaactgtggctgcaccactctgtcttcta

SEQ ID NO: 559923 - DNA, 498 bp, Homo sapiens; identical to SEQ ID NO: 535295
  misc_feature: HIJSMM301EH5KF.15.25.C03.1.454.light.4.raw

SEQ ID NO: 559924 - DNA, 507 bp, Homo sapiens
  misc_feature: HIJSMM301DN32E.49.28.C06.1.454.light.4.raw
agtcgagagacacgaccggtgctcgatttagagctcacgtattgggtttgggggctgtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgccaaaaagatatgcttattggtaccatcagaagtcaggccaggcccctgtactggtcatctatgaggacaccaaacgaccctccgggatccctacgagattctctggctccagtttagggacagtggccaccctgacagtcagtggggcccaggtggaggatgagggtgattactactgttactcaacagacattactactactcatagggtgttcggcggagggaccaagctgaccgtcctaggtcagcccaaggctgccccctcggtcactctgtt

SEQ ID NO: 559925 - DNA, 444 bp, Homo sapiens; identical to SEQ ID NO: 535192
  misc_feature: HIJSMM301CX8CN.5.9.A09.1.454.light.4.raw

SEQ ID NO: 559926 - DNA, 504 bp, Homo sapiens
  misc_feature: HIJSMM301C6I82.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcggagggaccaagctgaccgtcctgggtcagccaaggctgccccctcggtctac

SEQ ID NO: 559927 - DNA, 504 bp, Homo sapiens
  misc_feature: HIJSMM301EHKD3.17.87.H10.1.454.light.4.raw
cgtagactagcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttgggggttataaccttgtctcctggtaccaacaccacccagacaaagcccccaaactcatcctttatgagggcactaagcggccctcaggggtttctaatcgcttcgctggctccacgtctggcagcatggcctccctgacaatctctgggctccaggctgaggacgaggctgattattactgctgctcatattcaagtcgtgtcactatgatttttggcggtaggcaccaaggtgaccgtcctaggtcagcccaaggctgccccctcggt

SEQ ID NO: 559928 - DNA, 511 bp, Homo sapiens
  misc_feature: HIJSMM301DKQT4.40.12.B01.1.454.light.4.raw
tctagcgactcacgaccggtgctcgatttagtagtgtagattccgcgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccactacacccaggcaaagcccccaaactcatgatttctgacgtcagtaagcggccctcaggggtccctgatcgcttctctggctccaagtctggcaacacggcctcctgaccgtctctgggctccaggctgaagatgaggctgattattactgctactcgtatgcaggcggcaacaattgggtcttcggcggagggaccaaggctgaccgtcctaggtcagcccaaggctgccccctcggtcactctgttccg

SEQ ID NO: 559929 - DNA, 500 bp, Homo sapiens; identical to SEQ ID NO: 542309
  misc_feature: HIJSMM301ESZIA.12.86.H09.1.454.light.4.raw

SEQ ID NO: 559930 - DNA, 519 bp, Homo sapiens
  misc_feature: HIJSMM301CKRQX.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagtcgggtctgggacagacttcattctcaccatcaacagactgcagcctgaagatattgcagtttactactgtcagcagtatgttacgtccccgtggacgttcggccaagggaccaaggtggcaatcaaccgaactgtggctgcaccatctgtcttcattcttcccg

SEQ ID NO: 559931 - DNA, 486 bp, Homo sapiens
  misc_feature: HIJSMM301EOGEI.40.83.H06.1.454.light.4.raw
tctagcgactcacgaccggtgctcgatttagatcacgtgcgtcgcggggtccaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttcagcatggacggcagcctcagtgaatgggtgttcggcggagggaccaaactgtccgtcctaggtcagccccg

SEQ ID NO: 559932 - DNA, 502 bp, Homo sapiens
  misc_feature: HIJSMM301BVEY9.48.34.D01.1.454.light.4.raw
agtatacatacacgaccggtgctcgatttagatcgtctgtgttgggtttggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcgttatgaccttgtctcctggtaccaacaacacccaggcaaagcccccaaactcttgatttatgagatcactaagcggccctcaggcgtttctaatcgcttctctggctccaagtctggcaacacggcctccctgacaatctctgggctccaggctgaggacgaggctgattattattgctgctcatatgcaggtggtactacttgggtgttcggcagagggaccaagctgaccgtcctaggtcagcccaaggctgtccccccg

SEQ ID NO: 559933 - DNA, 508 bp, Homo sapiens
  misc_feature: HIJSMM301AEADM.22.28.C06.1.454.light.4.raw
acatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttgggtgttcggcggagggaccaggctgaccgtcctaggtcagcccaaggctg

SEQ ID NO: 559934 - DNA, 478 bp, Homo sapiens
  misc_feature: HIJSMM301CUQGA.26.72.G06.1.454.light.4.raw
agactatactcacgaccggtgctcgatttagctacgactgcaagggaaagggtgagatccctcactgtggctcactttcagcggagggaccacggtggagatcacacgtaagtgcactttcctaatgctttttcttataaggttttaagtttggagcgtttttgtgtttgagatgttagctcaggtcaattccaaagagtaccagattctttcaaaagtcagatgagtaagggatagaaaattagttcaccttaaggaacagccaagcgctagccagttaagtgaggcatctcaattgcaaggttttctctgcatcggtcaggttagtgatattaacagcgaaaagagatttttgttaaaggggaaagtaatgaagttaacactgtggatcaccttcggccaagggacacgactggagattaaacgaactgtggctgcaccatctgtcttcatcttcccgccatctgaagtatagtct

SEQ ID NO: 559935 - DNA, 517 bp, Homo sapiens; identical to SEQ ID NO: 539798
  misc_feature: HIJSMM301AXXM4.14.70.G04.1.454.light.4.raw

SEQ ID NO: 559936 - DNA, 486 bp, Homo sapiens; identical to SEQ ID NO: 536261
  misc_feature: HIJSMM301DAK1Y.26.55.E11.1.454.light.4.raw

SEQ ID NO: 559937 - DNA, 515 bp, Homo sapiens
  misc_feature: HIJSMM301E1EJT.13.38.D05.1.454.light.4.raw
tcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcggtccaacgggaccgaacggtggaaagtacaagcgaactacgtaggcgtgcgaccactctgtcttctatcttcccgt

SEQ ID NO: 559938 - DNA, 487 bp, Homo sapiens; identical to SEQ ID NO: 549731
  misc_feature: HIJSMM301AQ0BX.8.12.B01.1.454.light.4.raw

SEQ ID NO: 559939 - DNA, 490 bp, Homo sapiens; identical to SEQ ID NO: 546232
  misc_feature: HIJSMM301D4XIX.51.28.C06.1.454.light.4.raw

SEQ ID NO: 559940 - DNA, 484 bp, Homo sapiens
  misc_feature: HIJSMM301ALBHN.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacaggctgcccccaaccttcggccaggggacacgactggagattaaacgaactgtggctgcacatctgt

SEQ ID NO: 559941 - DNA, 494 bp, Homo sapiens
  misc_feature: HIJSMM301BQ6HY.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtggaggtcaaacgaactgtggctgcaccatctgtcttcattccc

SEQ ID NO: 559942 - DNA, 521 bp, Homo sapiens
  misc_feature: HIJSMM301A6TME.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagtccaaggctgccccctcggtcactctgttcccaccct

SEQ ID NO: 559943 - DNA, 503 bp, Homo sapiens; identical to SEQ ID NO: 537189
  misc_feature: HIJSMM301CIG61.19.85.H08.1.454.light.4.raw

SEQ ID NO: 559944 - DNA, 502 bp, Homo sapiens
  misc_feature: HIJSMM301CP0O5.10.71.G05.1.454.light.4.raw
catagtagtgcacgaccggtgctcgatttagtgtcgtcgcaagagagagggggagagccctggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccaaatagaggtcaaacgaactgtggctgcaccat

SEQ ID NO: 559945 - DNA, 490 bp, Homo sapiens
  misc_feature: HIJSMM301BF0WU.17.34.D01.1.454.light.4.raw
cgtagactagcacgaccggtgctcgatttagatcgtctgtgttgggtttggggtgatcaggacttctcagttcatcttctcaccatgaggctccctgctcagctcctggggctgctaatgctctggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactagaaaatcagccgggtggaggctggaggacgttggaatttattactgtatgcaaggtatagagcttcctccgacgttcgccgaagggaccaaggtggaactacaaacgaa

SEQ ID NO: 559946 - DNA, 506 bp, Homo sapiens; identical to SEQ ID NO: 536045
  misc_feature: HIJSMM301C3HNE.9.12.B01.1.454.light.4.raw

SEQ ID NO: 559947 - DNA, 489 bp, Homo sapiens
  misc_feature: HIJSMM301CJIIV.5.23.C01.1.454.light.4.raw
atcagacacgcacgaccggtgctcgatttagtacacgtgattagggattggggagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtggggtcccatcaaggttcagtggcagtggatctgggacagatttcactctcaccatcagtagtctacaacctgaagattttgcaacttactactgtcaacagagttacgatacccctccgctcactttcggcggagggaccaaggtggagatcaaacgaactgtggctgcaccatctgtctt

SEQ ID NO: 559948 - DNA, 521 bp, Homo sapiens
  misc_feature: HIJSMM301BIG09.48.24.C02.1.454.light.4.raw
agtatacatacacgaccggtgctcgatttagtacagatcgttagggaaaggggctgggcctaaggaagcagcactggtggtgcctcagccatggcctggaccgttctcctcctcggcctcctctctcactgcacaggctctgtgacctcctatgttctgactcagccaccctcggtgtcagtggccccaggaaagacggccaggattacctgtggaggaaacaacattggaagtaaaagtgtgcactggtaccagcagaagccaggccaggcccctgtgctggtcgtctttgatgataccgaccggccctcagggatccctgagcgattctctggctccaactctgtgaacacggccaccctgaccatcagcagggtcgaagccggggatgaggccgactattactgtcaggtgtgggatagtagtagtgatcatcctaattgggtgttcggcggagggaccaagctgaccgtcctaggtcagcccaaggctgccccctcggtccactctgttcccaccct

SEQ ID NO: 559949 - DNA, 495 bp, Homo sapiens; identical to SEQ ID NO: 538651
  misc_feature: HIJSMM301E3K8H.10.79.H02.1.454.light.4.raw

SEQ ID NO: 559950 - DNA, 454 bp, Homo sapiens; identical to SEQ ID NO: 535005
  misc_feature: HIJSMM301BQTNB.19.86.H09.1.454.light.4.raw

SEQ ID NO: 559951 - DNA, 488 bp, Homo sapiens
  misc_feature: HIJSMM301A74VF.3.55.E11.1.454.light.4.raw
agacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtatcccagccaggttcagtggcagtgggtctgggacagagttcattctcaccatcagcagcctgcagtctgaagattttgcaatttattactgtcagcagtataataactggtggacgttcggccaagggaccaaaggtagaaatcaaacgaactgtggctgcaccatctgt

SEQ ID NO: 559952 - DNA, 496 bp, Homo sapiens
  misc_feature: HIJSMM301EJLS7.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccaggggaccaagctggagatcaaacgaactgtggctgcacatctgtt

SEQ ID NO: 559953 - DNA, 495 bp, Homo sapiens
  misc_feature: HIJSMM301B5U53.51.12.B01.1.454.light.4.raw
cgatcgtatacacgaccggtgctcgatttagtagtgtagattccgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcta

SEQ ID NO: 559954 - DNA, 494 bp, Homo sapiens; identical to SEQ ID NO: 541183
  misc_feature: HIJSMM301B6CD1.19.71.G05.1.454.light.4.raw

SEQ ID NO: 559955 - DNA, 493 bp, Homo sapiens
  misc_feature: HIJSMM301BB15H.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggccagcagtggtaacattgtgatattcggcggagggaccaaggtgaccgtcctacgtcagcccaaggctgccccctggtccact

SEQ ID NO: 559956 - DNA, 502 bp, Homo sapiens
  misc_feature: HIJSMM301B7DX1.17.41.D08.1.454.light.4.raw
cgtagactagcacgaccggtgctcgatttagtcacgcgagaaagggaaaggggagagctgctcagttaggacccagagggaaccatggaaaccccagcgcagcttctcttcctcctgctactctggctcccagataccaccggagaaattgtgttgacgcagtctccaggcaccctgtccttgtctccaggggaaacagccaccctctcctgtagggccagtcagagtgtttttaaaactatttagcctggtaccaacagaagcctggccaggctcccaggctcctcatctatggtgcatccaccagggccactggcatcccagacaggttcagtggcggtgggtctgggacagaattcactctcaccatcaccagtctggagcctgaagattttgctctgtatcactgtcagcaatatggtgtacacccctcactttcggcggagggccaaggtggagatcaagcgaactgtggctgcaccatctgtcttcatcttcccgc

SEQ ID NO: 559957 - DNA, 494 bp, Homo sapiens
  misc_feature: HIJSMM301AUAC9.15.83.H06.1.454.light.4.raw
tctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaaattggtatcagcagaaaccagggaaagcccctaagctcctgatctatggtgcatccagtttgcaaagtggggccccatcaaggttcagtggcagtggctctgggacagatttcactctcaccatcagcagtctccaacctgaagattttgcaacttactactgtcaacagagtttcagtagtccccggacgtgtccaaggacgaacggtaggacgatacaacgaaactataggctcgcaccatctgtctt

SEQ ID NO: 559958 - DNA, 500 bp, Homo sapiens
  misc_feature: HIJSMM301AUYRA.4.34.D01.1.454.light.4.raw
agcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgcttactggtaccagcagaagccaggccaggcccctgtgttgctgttatataaagacagtgagaggccctcagggatccctgagcgattctctggctccagctcagggacaacagtcacgttgaccatcagtggagtccaggcagaagacgaggctgactattactgtcaatcagcagacagcggtgggacttataaaggtaggtcggcggacggacaagcgtacgaccgtacgtacggtacacgaccgaaggtcgtccccg

SEQ ID NO: 559959 - DNA, 482 bp, Homo sapiens; identical to SEQ ID NO: 548071
  misc_feature: HIJSMM301BI4W0.4.74.G08.1.454.light.4.raw

SEQ ID NO: 559960 - DNA, 489 bp, Homo sapiens
  misc_feature: HIJSMM301C7ZGR.52.25.C03.1.454.light.4.raw
cgcagtacgacacgaccggtgctcgatttagtagtgtagatttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagcagttatttagcctggtatcagcaaaaaaccagggaacgcccctaagctcctgatctatggtgcatcaactttgcaaggtggggtcccatcaaggttcagcggcagtggatctgggacagaattcactctcacaatcagcagcctgcagcctgaagattttgcaacttattactgtcaacaccttaatagttactccttcactttcggccctggaccaaagtggacatcaaacgaactgtggctgcaccatctgtcttcta

SEQ ID NO: 559961 - DNA, 484 bp, Homo sapiens; identical to SEQ ID NO: 540581
  misc_feature: HIJSMM301AQHEP.3.88.H11.1.454.light.4.raw

SEQ ID NO: 559962 - DNA, 482 bp, Homo sapiens
  misc_feature: HIJSMM301AZNCW.52.40.D07.1.454.light.4.raw
cgcagtacgacacgaccggtgctcgatttagtgatagagcgtaacaacgagaggggagtcccagtcaggacacagcatggacatgagggtccccgctcagctcctggggctcctgctgctctggctcccaggtgccagatgtgacatcccagttgacccagtctccatccttcctatctgcatctggtaggagacagagtcaccatcacttgtcgggcgagtcagggtattagcagctggttagcctggtatcagcagaaaccagggaaagcccctaagctcctgatctatgctgcatccactttgcagagtggggtcccatcaaggttcagcggcacgtggatctgggagacaattcactctcacaatcagcagcctgcagcctgaagattttgcgacttattactgtcaacaacttaatcgttaccctcttttcggccctgggaccaaagtggatatcaaacgaactgtggctgcaccat

SEQ ID NO: 559963 - DNA, 449 bp, Homo sapiens
  misc_feature: HIJSMM301CZAFR.18.9.A09.1.454.light.4.raw
tacgagtatgcacgaccggtgctcgatttagcgagacgcgcagggtcctgggcccaggtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcacctgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccgccctcctccatactcgta

SEQ ID NO: 559964 - DNA, 503 bp, Homo sapiens; identical to SEQ ID NO: 551912
  misc_feature: HIJSMM301DDOGS.12.50.E06.1.454.light.4.raw

SEQ ID NO: 559965 - DNA, 490 bp, Homo sapiens
  misc_feature: HIJSMM301C1YE6.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtgggtcccgtcaaggttcagtggcagtggatctgggacagatttcactctcaccatccgcggtctgcaacctgaagatttcgcaacttactactgtcaacagacttacagtgcccccccgatccaccttcggccaagggacacgactggagattaaacgaactgtggctgcaccatctgtcttcat

SEQ ID NO: 559966 - DNA, 500 bp, Homo sapiens
  misc_feature: HIJSMM301A7MSA.51.5.A05.1.454.light.4.raw
  modified_base (479)..(479): a, c, t, g, unknown or other
cgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaagaaatctgctttttggtaccatcagaggccaggccaggcccctgtattggtcatctatgaggacaccaagcgaccctccggaatccctgagagagtcgctggctccaggtcagggacaatggccaccttgactatcactgggacccagatggacgatgaaggtgactaccacctgttattcgacagacagcagtggtagtcagggggtcttcggcggagggacgaagctgaccgtcctgaggtcagcccaaggcncgccccctcggtcactctgtt

SEQ ID NO: 559967 - DNA, 478 bp, Homo sapiens
  misc_feature: HIJSMM301EOIJJ.49.78.H01.1.454.light.4.raw
agtcgagagacacgaccggtgctcgatttagtgtgagtagtttgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctcccgctcactttcggtcgggggaccgaaggtggagatcaagcgaactgtggctgcacc

SEQ ID NO: 559968 - DNA, 502 bp, Homo sapiens
  misc_feature: HIJSMM301AXCEL.4.39.D06.1.454.light.4.raw
agcactgtagcacgaccggtgctcgatttagtgacatctcgcagttctttggggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccaaactgaccgtcctggtcagcccaaggctgccccctc

SEQ ID NO: 559969 - DNA, 519 bp, Homo sapiens
  misc_feature: HIJSMM301DK11N.12.71.G05.1.454.light.4.raw
atacgacgtacacgaccggtgctcgatttagtgtcgtcgcaagagagaggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgaggacactaagcggccctcaggagtttctgatcgcttctctggctccaaggctggcgaccggggcctccctgacaatatctgggctccaggctgaggacgaggctcattactactgctgctcatatggaggttatagcacttgggtgttcggcggcgggaccaaagtgaccgtcctaagtcagcccaaggctgccccctcggtcactctgttcccaccct

SEQ ID NO: 559970 - DNA, 495 bp, Homo sapiens
  misc_feature: HIJSMM301AFGVQ.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgcagtttattactgtaagcagtataattactggcctcggacgttcggccaagggaccaaggtggaagtcaacgaactagtggcgtgcaccatctgtcttcta

SEQ ID NO: 559971 - DNA, 498 bp, Homo sapiens
  misc_feature: HIJSMM301DU3OU.3.33.C11.1.454.light.4.raw
agacgcactccacgaccggtgctcgatttagagtgagctcgttgggtttgggggggtcgtcaggaggcagcgctctcaggacgtcaccaccatggcctgggctctgctcctcctcaccctcctcactcagggcacagggtcctgggcccagtcttccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccctc

SEQ ID NO: 559972 - DNA, 476 bp, Homo sapiens; identical to SEQ ID NO: 538611
  misc_feature: HIJSMM301CSQDO.7.81.H04.1.454.light.4.raw

SEQ ID NO: 559973 - DNA, 486 bp, Homo sapiens; identical to SEQ ID NO: 535458
  misc_feature: HIJSMM301CTMPI.7.75.G09.1.454.light.4.raw

SEQ ID NO: 559974 - DNA, 491 bp, Homo sapiens
  misc_feature: HIJSMM301AO3SN.16.68.G02.1.454.light.4.raw
tgtactactccacgaccggtgctcgatttagtcgatagtgaagggaaagggggagtcagacccagtcaggacacagcatggacatgagggtccccgctcagctcctgggactcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtggaggtcaaacgaactgtggctgcaccatctgtcttcatt

SEQ ID NO: 559975 - DNA, 463 bp, Homo sapiens; identical to SEQ ID NO: 535062
  misc_feature: HIJSMM301D53A2.11.73.G07.1.454.light.4.raw

SEQ ID NO: 559976 - DNA, 521 bp, Homo sapiens; identical to SEQ ID NO: 538715
  misc_feature: HIJSMM301A6AHE.27.23.C01.1.454.light.4.raw

SEQ ID NO: 559977 - DNA, 498 bp, Homo sapiens
  misc_feature: HIJSMM301B097W.3.31.C09.1.454.light.4.raw
agacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccgaggggaaagagccaccctctcctgcagggccagtcagagtgttagcaactacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgctagtttattactgtcagcagcgtagcaactggcctctcactttcggcggagggaccaaggtggagatacaaacgaactgtggctgcaccatctgtctt

SEQ ID NO: 559978 - DNA, 524 bp, Homo sapiens
  misc_feature: HIJSMM301D50TW.17.75.G09.1.454.light.4.raw
cgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtgtccccaggggggacagtcattctcacctgtgcctccagcactggagaagtgaccagcggccactatccctactggttccagatgaagtctggccaggcccccaggacactaatttatgatgcgaccaacagacactcctgggcgcctggccgtttttcgggctccctcctcggggcaaagctgccctgaccctaacggggcgcagcctgaggacgaggtcgactattattgcctactatcatttgatggtggtcgtctgcccattttcggcggcgggaccagggtggccgtcctgggtcagcccaaggctgccccctcggtcactctgttcccaccctcctcctagtctacg

SEQ ID NO: 559979 - DNA, 500 bp, Homo sapiens
  misc_feature: HIJSMM301BPQP2.41.35.D02.1.454.light.4.raw
tctatactatcacgaccggtgctcgatttagcacacgatagttgggtttgggggctttgcctgggctctgctgctcctcactctcctcactcaggacacagggtcctgggcccagtctgccctgactcagcctgcctccgtgtctgggtctcctggacagtcgatcaccatctcctgcactggtaccatcagcgatgttgattattataaccttgtctcctggtaccaacaacacccaggcaaagcccccaaactcctgatttatgagggcgatcagcggccctcaggggtttctgatcgcttctctggctccaagtctggcaatacggcctccctgacagtctctcggctccaggcggaggacgaggctgattactactgcttctcatatgcagatactaagtcctgggtgttcggcggagggaccaagctgaccgtcctaggtcagcccaaggctgccccctcggtcactctcgttcccgccctcctcatagtataga

SEQ ID NO: 559980 - DNA, 496 bp, Homo sapiens; identical to SEQ ID NO: 535109
  misc_feature: HIJSMM301DQ0G8.16.78.H01.1.454.light.4.raw

SEQ ID NO: 559981 - DNA, 486 bp, Homo sapiens; identical to SEQ ID NO: 549209
  misc_feature: HIJSMM301AGYVX.43.36.D03.1.454.light.4.raw

SEQ ID NO: 559982 - DNA, 441 bp, Homo sapiens; identical to SEQ ID NO: 535074
  misc_feature: HIJSMM301CRZE8.11.3.A03.1.454.light.4.raw

SEQ ID NO: 559983 - DNA, 488 bp, Homo sapiens
  misc_feature: HIJSMM301BENVP.17.34.D01.1.454.light.4.raw
cgtagactagcacgaccggtgctcgatttagatcgtctgtgttgggtttggggtgatcaggacttctcagttcatcttctcaccatgaggctccctgctcagctcctggggctgctaatgctctggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttcctccgacgttcggccaagggaccgaaggtggaactcaaacgaa

SEQ ID NO: 559984 - DNA, 506 bp, Homo sapiens
  misc_feature: HIJSMM301EJW8O.9.71.G05.1.454.light.4.raw
tgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggaccccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcggagggaccaggctgaccgtcctgagtcagcccaaggctcgccccccg

SEQ ID NO: 559985 - DNA, 447 bp, Homo sapiens
  misc_feature: HIJSMM301E0VU5.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaaacccctctgtcactctgttcccaccctcctcctactcgta

SEQ ID NO: 559986 - DNA, 476 bp, Homo sapiens
  misc_feature: HIJSMM301B36GP.51.55.E11.1.454.light.4.raw
cgatcgtatacacgaccggtgctcgatttagcactcgcacgttgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattactgtcaacagtatgatagtctcccgctcactttcggtcgggggaccgaaggtggagatcaagcgaactgtggctgca

SEQ ID NO: 559987 - DNA, 503 bp, Homo sapiens
  misc_feature: HIJSMM301CDAGQ.19.67.G01.1.454.light.4.raw
tactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttctccacctccaagaacaaaaacttcttagcctggtaccaacagagaccaggacagcctcctaagttgctcatttactgggcttctacgcgcgaattcggggtccctgaccgattccggggcagcgggtctgggacagatttcactctcaccatcagcagcctgcaggctgaagatgtggcagtttattactgtcagcaatatttttcttatcctccgtggacgttcggccaaggaccagggtggaaatcagacgaactgtggctgcaccat

SEQ ID NO: 559988 - DNA, 510 bp, Homo sapiens
  misc_feature: HIJSMM301EX324.8.33.C11.1.454.light.4.raw
ctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctcgggaccgaaggtggagatacaaacgaactgtggctgcaccatctgtcttcta

SEQ ID NO: 559989 - DNA, 485 bp, Homo sapiens; identical to SEQ ID NO: 535880
  misc_feature: HIJSMM301ESYS0.7.75.G09.1.454.light.4.raw

SEQ ID NO: 559990 - DNA, 484 bp, Homo sapiens; identical to SEQ ID NO: 537891
  misc_feature: HIJSMM301CT73U.10.1.A01.1.454.light.4.raw

SEQ ID NO: 559991 - DNA, 485 bp, Homo sapiens; identical to SEQ ID NO: 556441
  misc_feature: HIJSMM301CFNF3.48.86.H09.1.454.light.4.raw

SEQ ID NO: 559992 - DNA, 529 bp, Homo sapiens
  misc_feature: HIJSMM301DONL9.52.61.F06.1.454.light.4.raw
cgcagtacgacacgaccggtgctcgatttagctacgctctaagggaaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccggaaatgacattggtggttataattatgtctcctggtaccaacaccacccaggcaaagcccccaaactcatgatttatggtgtcggtgaccggccctcaggggtttcgaatcgcttctctggctccaagtccggcaacacggcctccctgaccatctctggcctccaggccgaggacgaggctgattattactgcgcctcatatacaaacaacaacaattgggtgttcggcggagggaccaagctgaccgtcctaggtcagcccaaggctgccccctcggtcactctgttcccgccctcctcta

SEQ ID NO: 559993 - DNA, 496 bp, Homo sapiens
  misc_feature: HIJSMM301CM3Z8.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcctatcaaggttcagcggcagtgaaactgggacagaattcattctcaccatcagcagcctgcagcctgatgattttgcaacttattactgccaacagtataagagttatccgtggacgttcggccaagggaccagggtggaaatcaaacgaactagtggctgcaccatctgtcttcatt

SEQ ID NO: 559994 - DNA, 492 bp, Homo sapiens
  misc_feature: HIJSMM301EGL9L.9.21.B10.1.454.light.4.raw
tgatacgtctcacgaccggtgctcgatttagtgtcgtcgcaggaggagggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcggagggaccaggctgaccgtcctgagtcagcccaaggctg

SEQ ID NO: 559995 - DNA, 496 bp, Homo sapiens
  misc_feature: HIJSMM301DI3IM.11.57.F02.1.454.light.4.raw
cgagagataccacgaccggtgctcgatttagctcgatatagttgggtttgggggaggaactgctcagttaggacccagacggaaccatggaagccccagcgcagcttctcttcctcctgctactctggctcccagagaccacgggagacatagtgctgacgcagtctccagccaccctgtctgtgtctccaggggacagagccaccctctcctgcagggccagtcagactattagttacaccttagcctggtaccagcaaaaacctggccaggctccccggctcctcatctatggtgcatccaccagggccgctggtgtcccacccaggttcagtggcggtgggtctgggacagtgttcactctcaccatcagcagcctgcagtctgaagattttgcagtttattactgtcagcagtatagtaagtggccgctcactttcggcggagggaccaaggtggagatcagacgaactgtggctgcaccatctgtcttcat

SEQ ID NO: 559996 - DNA, 483 bp, Homo sapiens
  misc_feature: HIJSMM301BC3O8.12.33.C11.1.454.light.4.raw
atacgacgtacacgaccggtgctcgatttagagtgagctcgttgggtttgggggcaggagtcagtctcagtcaggacacagcatggacatgagggtccccgctcagctcctggggctcctgctactctggctccgaggtgccagatgtgacatccagatgacccagtctccttcctccctgtctgcatctgtcggagacagcgtcaccatcacttgtcgggcaagtcagaacatttacaattatttaaattggtatcagcagaaaccagggaaagcccctaaatcctgatctatcatgaatccagtttgcgaagtggagtcccatcaaggttcagtggcactgggtctgagacagagttcactctcaccatcagcactctacagcctgaagattttgcaacttattattgtcaacaaagttatgagacccctgccacttcggccctggaccatagtggatatagaacgaactgtggctgcacc

SEQ ID NO: 559997 - DNA, 488 bp, Homo sapiens; identical to SEQ ID NO: 537124
  misc_feature: HIJSMM301BP10E.11.25.C03.1.454.light.4.raw

SEQ ID NO: 559998 - DNA, 492 bp, Homo sapiens
  misc_feature: HIJSMM301AGSMR.49.17.B06.1.454.light.4.raw
agtcgagagacacgaccggtgctcgatttagtcgatagtgaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaacaatatgcttactggtaccagcagaggccaggccaggcccctgtcttggtgatttataaagaccttgagaggccctcagggacccctgagcgattctctggctccagctcagggacaacagtcaccttgaccatcagtggagtccggccagaggacgaggctgactattactgtcagtccgcagacagcagtggcagttatgtcgtattcggcggagggactacgctgaccgtcctaggtcagcccaaggctgccccctcggtcact

SEQ ID NO: 559999 - DNA, 493 bp, Homo sapiens; identical to SEQ ID NO: 535084
  misc_feature: HIJSMM301BNJ3W.47.64.F09.1.454.light.4.raw

SEQ ID NO: 560000 - DNA, 506 bp, Homo sapiens
  misc_feature: HIJSMM301A1VM9.51.2.A02.1.454.light.4.raw
cgatcgtatacacgaccggtgctcgatttagactcatctacagggggtctgggcctaaggaagcagcactggtggtgcctcagccatggcctggaccgttctcctcctcggcctcctctctcactgcacaggctctgtgacctcctatgtgctgagtcagccaccctcggtgtcggtggccccaggacagacggccaggattacctgtgggggaaacaacattggaagtaaaactgtgcactggtaccagcagaagccaggccaggcccctgtgctggtcgtctatgatgatgccgaccggccctcagggatccctgaacgattctctggctccagctctgagaacacggccaccctgagcatcagcagggtcgaagccggggatgaggccgactattactgtcaggtgtgggatactagtagtgatcatgtcttcggacctgggaccaaggtcaccgtcctaggtcagcccaaggccaaccccactgtcactctgttcccaccct

SEQ ID NO: 560001 - DNA, 473 bp, Homo sapiens; identical to SEQ ID NO: 541472
  misc_feature: HIJSMM301CVI9Y.5.12.B01.1.454.light.4.raw

SEQ ID NO: 560002 - DNA, 493 bp, Homo sapiens
  misc_feature: HIJSMM301BS7HG.17.21.B10.1.454.light.4.raw
cgtagactagcacgaccggtgctcgatttagtgtcgtcgcaaggggacgtgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcaggggtacactctggccgttcacttttggccaggggaccaaaactggatatcagacgaactgtggctgca

SEQ ID NO: 560003 - DNA, 472 bp, Homo sapiens
  misc_feature: HIJSMM301B82F1.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagcctgcagtctgaggattttgcagtttattactgtcagcattacaataactggcctcggctcactttcggcggagggaccaaggtggagatcaaacgaa

SEQ ID NO: 560004 - DNA, 480 bp, Homo sapiens; identical to SEQ ID NO: 540601
  misc_feature: HIJSMM301AI2QI.40.21.B10.1.454.light.4.raw

SEQ ID NO: 560005 - DNA, 513 bp, Homo sapiens
  misc_feature: HIJSMM301AI4BF.8.38.D05.1.454.light.4.raw
ctcgcgtgtccacgaccggtgctcgatttagtatctgatagttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaaattagagatcaaacgaaactagtggctgcaccatctgtcttctatcttccgt

SEQ ID NO: 560006 - DNA, 518 bp, Homo sapiens; identical to SEQ ID NO: 539372
  misc_feature: HIJSMM301B5FKQ.7.86.H09.1.454.light.4.raw

SEQ ID NO: 560007 - DNA, 503 bp, Homo sapiens
  misc_feature: HIJSMM301AR04T.49.73.G07.1.454.light.4.raw
agtcgagagacacgaccggtgctcgatttagctctacgctcagggcacgaccggtgctcgatttagagctcacgtattgggtttgggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgccaaaaagatatgcttattggtaccatcagaagtcaggccaggcccctgtactggtcatctatgaggacaccaaacgaccctccgggatccctacgagattctctggctccagtttagggacagtggccaccctgacagtcagtggggcccaggtggaggatgagggtgattactactgttactcaacagacattactactactcatagggtgttcggcggagggaccaagctgaccgtcct

SEQ ID NO: 560008 - DNA, 525 bp, Homo sapiens
  misc_feature: HIJSMM301BZZ77.19.81.H04.1.454.light.4.raw
tactctcgtgcacgaccggtgctcgatttagtagtgtagattcgcgggctggcaccaggggtcccttccaatatcagcaccatggcctggactcctctctttctgttcctcctcacttgctgcccagggtccaattcccaggttgtggtgactcaggagccctcactgactgtggccccaggagggacagtcactctcacctgtggctccaacgctggacgtgtcacctctgatcaatatccctattggtatcagcagaagcctggccaagcccccaagacactgatttctgatacaaccaacagacattccttgacacccgcccgcttttcaggttacctccttgggggcaaagctgccctgaccctttcgggcgcgcagcctgaggatgaggcagagtacctgtgttccctcgtccactccggtttttttgtgttcggtcggagggaccgagactgaccgtcctcggtcagcccaaggctgcccctccggtcacctctgttcccaccctcctccacgagagta

SEQ ID NO: 560009 - DNA, 503 bp, Homo sapiens
  misc_feature: HIJSMM301CSZ00.9.12.B01.1.454.light.4.raw
tgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggtccaacgggaccaaggtggaaagtcaaacgaacctagtggctgcacca

SEQ ID NO: 560010 - DNA, 504 bp, Homo sapiens; identical to SEQ ID NO: 536385
  misc_feature: HIJSMM301C0WS7.27.78.H01.1.454.light.4.raw

SEQ ID NO: 560011 - DNA, 508 bp, Homo sapiens
  misc_feature: HIJSMM301EYHGX.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggcctccagcctgacgacgaggctgactactactgctcagcctgggacaccagcctcgctgcttggcttttcggcggaggggaccaaaggctgaccgtccctgggtcagcccaaggctgccccctccggtc

SEQ ID NO: 560012 - DNA, 487 bp, Homo sapiens
  misc_feature: HIJSMM301DPKZF.10.2.A02.1.454.light.4.raw
catagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccaccctctcctgcagggccagtcagagtgttggcagcaggttagcctggtaccagcagaaacgtggccaggctcccaggctcctcgtatatggtgcatccaccagggccactggtatctcaggcaggttccgtggcaggtgggtctgggacagagttcactgtcaccatcagcagcctgcagtctgaagattttgcagtttattactgtcagcagtataatagctggcccgcgacgttcggccaagggaccgaggtggaattacaacgaactgtggctgcaccatctgtctt

SEQ ID NO: 560013 - DNA, 501 bp, Homo sapiens; identical to SEQ ID NO: 535746
  misc_feature: HIJSMM301EF6Z5.18.11.A11.1.454.light.4.raw

SEQ ID NO: 560014 - DNA, 501 bp, Homo sapiens
  misc_feature: HIJSMM301CGE9X.47.78.H01.1.454.light.4.raw
agctcacgtacacgaccggtgctcgatttagtgtgagtagtttgggtttggggtgatcaggactcctcagttcaccttctcacaatgaggctccctgctcagctcctggggctgctaatgctctgggtcccagatccagtggggatgttgtgatgactcagtctccactctccctgtccgtcacccttgcacagccggcctccatctcctgttggtctggtcaaggcctcgaatacagtgatggaaacacctgcttgaattgctttcaccagaggccaggcccatctccaaggcgcctaatttataagctttctaaccgggactctggggtcccagacagattcagcggcagtggcactgatgtcacactgacaatcagcagggtgggaggcgtgaggatgttgggtttggttctcctatgcaaggtacacactggcctttgttcgacggacggaaccacgaggatacaataagaactagtggtgtgcacactctgtcttt

SEQ ID NO: 560015 - DNA, 496 bp, Homo sapiens
  misc_feature: HIJSMM301AKYWA.51.33.C11.1.454.light.4.raw
cgatcgtatacacgaccggtgctcgatttagagtgagctcgttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataatttggggtctaagtatgtttcgtggtatcaacatcacccaggccggtccccgatactgctcctctatcatgatgccaagcggccctcagggatccctgagcgattctctggctccaactctggggacacagccactctgaccatccgcgggacccaggctgtggatgaggctgactattactgtcaggcgtgggacagggaggctgcgattttcggcggagggaccagtctgaccgtcctaggtcagcccaaggctgccccctcggtcactc

SEQ ID NO: 560016 - DNA, 514 bp, Homo sapiens
  misc_feature: HIJSMM301AJA7Q.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccagctgaccgtcctaggtcagcccaaggctgcctcctcggtcactctgttcccaccctcctc

SEQ ID NO: 560017 - DNA, 502 bp, Homo sapiens
  misc_feature: HIJSMM301CS1FO.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcacgtcctaggtcagcccaaggccaacccca

SEQ ID NO: 560018 - DNA, 508 bp, Homo sapiens
  misc_feature: HIJSMM301BZ8OB.51.38.D05.1.454.light.4.raw
cgatcgtatacacgaccggtgctcgatttagtatctgatagttgggtttggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaagcccccaaactcatgatttatgatgtcagtgatcggccctcaggggtttcaatcgcttctctggctccaagtccggcaacacggcctccctgaccatctctggcctccaggccgaggacgaggctgattattactgcagctcatatacaatcaataacaattgggtgttcggcggagggaccaaactgaccgtcctaggtcagcccaaggctgccccctcggtcact

SEQ ID NO: 560019 - DNA, 495 bp, Homo sapiens; identical to SEQ ID NO: 542410
  misc_feature: HIJSMM301BBBD9.26.12.B01.1.454.light.4.raw

SEQ ID NO: 560020 - DNA, 486 bp, Homo sapiens; identical to SEQ ID NO: 535043
  misc_feature: HIJSMM301DCXFC.46.35.D02.1.454.light.4.raw

SEQ ID NO: 560021 - DNA, 493 bp, Homo sapiens; identical to SEQ ID NO: 535770
  misc_feature: HIJSMM301CX96F.51.71.G05.1.454.light.4.raw

SEQ ID NO: 560022 - DNA, 476 bp, Homo sapiens
  misc_feature: HIJSMM301ARV21.13.76.G10.1.454.light.4.raw
tcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtcccccaggaccagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcaccgtcctaagtcagaccc

SEQ ID NO: 560023 - DNA, 502 bp, Homo sapiens
  misc_feature: HIJSMM301BV9H5.48.35.D02.1.454.light.4.raw
agtatacatacacgaccggtgctcgatttagcacacgatagttgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctttgaggacaacaaacgaccctccgggatccctgagagattctctggctccagctcagggacaatggccaccttgactatcaatggggcccaggtggacgatgaggctgactactactgttcctcaacagacagtagtggtgatcgagggctgttcggcggagggaccaagctgaccgtcctaagtcagcccaaggctgccccctggtcactctcg

SEQ ID NO: 560024 - DNA, 487 bp, Homo sapiens
  misc_feature: HIJSMM301DGBXJ.26.70.G04.1.454.light.4.raw
agactatactcacgaccggtgctcgatttagtgtagtgtgaagggaaagggggcaggaatcagacccagtcaggacacagcatggacatgagagtcctcgctcagctcctggggctcctgctgctctgtttcccaggtgccagatgtgacatccagatgacccagtcgccatcctcactgtctgcctctgtaggagacagagtcaccatcacttgtcgggcgagtcagggcattagcgattttttagcctggtttcagcagaaaccagggaaagcccccaagtccctgatctatgctgcgtccactttagaaggtggagtcccatcaaggttcagcggcagtggatctgggacagagttcactctcaacatcagcagcctgcagcctgaggattttgcaacttattactgccagcagtataatgattaccctatcaccttcggccgggggacgacggctggaaactaaacgaactgtggctgcacca

SEQ ID NO: 560025 - DNA, 487 bp, Homo sapiens
  misc_feature: HIJSMM301CT9T9.13.87.H10.1.454.light.4.raw
tcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagcaaaaaccagggaaagtccctaagctcctgatctatgttgcatccactttgcaaagtgggtcccatcaaggttcagcggcagtggatctgggacagaattcactctcacaatcagcagcctgcagcctgaagattttgcaacttattactgtcaacagcttaatagttacccgctcagtttcggcggagggaccaaggtggagatcaaacgaactgtggctgcaccatctgtt

SEQ ID NO: 560026 - DNA, 505 bp, Homo sapiens; identical to SEQ ID NO: 536117
  misc_feature: HIJSMM301EG80D.8.71.G05.1.454.light.4.raw

SEQ ID NO: 560027 - DNA, 490 bp, Homo sapiens; identical to SEQ ID NO: 539098
  misc_feature: HIJSMM301AU7NA.51.80.H03.1.454.light.4.raw

SEQ ID NO: 560028 - DNA, 494 bp, Homo sapiens; identical to SEQ ID NO: 535478
  misc_feature: HIJSMM301CPDZ2.10.79.H02.1.454.light.4.raw

SEQ ID NO: 560029 - DNA, 484 bp, Homo sapiens; identical to SEQ ID NO: 535400
  misc_feature: HIJSMM301AR7SE.46.26.C04.1.454.light.4.raw

SEQ ID NO: 560030 - DNA, 504 bp, Homo sapiens
  misc_feature: HIJSMM301C1Y35.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcggagggaccaagctgaccgtcctgggtcagcccaaggctggccccctcggtca

SEQ ID NO: 560031 - DNA, 495 bp, Homo sapiens
  misc_feature: HIJSMM301ADCKZ.46.35.D02.1.454.light.4.raw
actagcagtacacgaccggtgctcgatttagcacacgatagttgggtttgggggagctgctcagttaggacccagagggaactatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagtattttgctagtctattactgtcagcagtatggtcacgtcccaagtaacttttggccgacgggaccgaagcgtggagatacaaacgaactagtggctcgcaccat

SEQ ID NO: 560032 - DNA, 507 bp, Homo sapiens; identical to SEQ ID NO: 535641
  misc_feature: HIJSMM301DMZBS.10.88.H11.1.454.light.4.raw

SEQ ID NO: 560033 - DNA, 501 bp, Homo sapiens
  misc_feature: HIJSMM301BX0V9.4.39.D06.1.454.light.4.raw
agcactgtagcacgaccggtgctcgatttagtgacatctcgcagttctttggggggagtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccaaactgaccgtcctaggtcagcccaaggctgcccccc

SEQ ID NO: 560034 - DNA, 445 bp, Homo sapiens; identical to SEQ ID NO: 536433
  misc_feature: HIJSMM301AH8DH.5.9.A09.1.454.light.4.raw

SEQ ID NO: 560035 - DNA, 485 bp, Homo sapiens; identical to SEQ ID NO: 550410
  misc_feature: HIJSMM301D7UVG.14.53.E09.1.454.light.4.raw

SEQ ID NO: 560036 - DNA, 526 bp, Homo sapiens
  misc_feature: HIJSMM301C6EY9.10.38.D05.1.454.light.4.raw
catagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccacccaggcaaacgcccccaaactccttgtttttgaggtcagtaagcggccctcaggagtccctgattcggttctctgcctccaagtctggcaacacggcctccctgaccgtctctgggctccaggctgaggatgaggctgattactactgcagcgcatattcacggccccaacagggttgtttggcggcgggactaaggtcgaccgtcctgggtcacgcccaaggctcgccccctcggtcactctcgttcccaccctt

SEQ ID NO: 560037 - DNA, 485 bp, Homo sapiens; identical to SEQ ID NO: 536040
  misc_feature: HIJSMM301EH0G8.15.1.A01.1.454.light.4.raw

SEQ ID NO: 560038 - DNA, 489 bp, Homo sapiens
  misc_feature: HIJSMM301COI12.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggcggagggaccagggtggagatcaaacgaactgtggctgcaccatctgtctt

SEQ ID NO: 560039 - DNA, 485 bp, Homo sapiens
  misc_feature: HIJSMM301CZU56.41.54.E10.1.454.light.4.raw
tctatactatcacgaccggtgctcgatttagatcgtagcagaacacacaaagggggatcaggactcctcagttcaccttctcacaatgaggctccctgctcagctcctggggctgctaatgctctgggtcccaggatgcagtggggatgctattctgactcagtcgccgctctccctgcccgtctcccttggacagccggcctccatttcctgcacgtctagtcaaagtctcctacatgatgatggaaacacctacctgacttggtttcaccacaggccaggccaatctccaaggcgcctaatttatcaggtttcgaagcgggactctggggtcccaggcagattcagcggcagtgggtcaggctctgctttcacgctgagaatcaacagggtggaggctgaggatgttggtgtttattactgcatgcaaggttcatattggccgtgcagttttggccaggggaccaagttggagatcaaacgaa

SEQ ID NO: 560040 - DNA, 478 bp, Homo sapiens; identical to SEQ ID NO: 535129
  misc_feature: HIJSMM301EHNCT.11.11.A11.1.454.light.4.raw

SEQ ID NO: 560041 - DNA, 491 bp, Homo sapiens; identical to SEQ ID NO: 536693
  misc_feature: HIJSMM301EGJQF.19.83.H06.1.454.light.4.raw

SEQ ID NO: 560042 - DNA, 497 bp, Homo sapiens; identical to SEQ ID NO: 548608
  misc_feature: HIJSMM301DND3P.51.71.G05.1.454.light.4.raw

SEQ ID NO: 560043 - DNA, 485 bp, Homo sapiens; identical to SEQ ID NO: 536576
  misc_feature: HIJSMM301B8CUO.46.35.D02.1.454.light.4.raw

SEQ ID NO: 560044 - DNA, 493 bp, Homo sapiens; identical to SEQ ID NO: 535745
  misc_feature: HIJSMM301BA4PK.47.78.H01.1.454.light.4.raw

SEQ ID NO: 560045 - DNA, 483 bp, Homo sapiens
  misc_feature: HIJSMM301EQ274.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgagatgttggctctattatgcatgcaagctctacaacgtcccgctcactttcggcggaggaccgaaggtggagatacaaacgaa

SEQ ID NO: 560046 - DNA, 499 bp, Homo sapiens
  misc_feature: HIJSMM301B1QIO.15.25.C03.1.454.light.4.raw
tctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggttctaatcgggcctccggggtccctgacaggttcagtggcagtggatcaggcatagattttacactgaaaatcagcagagtggaggctgaggacgttggggtttattactgcatgcaaggtctacaaaccccgatcaccttcggccgagggacacgcctggacgattaaacgaactgtggctgcaccat

SEQ ID NO: 560047 - DNA, 536 bp, Homo sapiens
  misc_feature: HIJSMM301AMMZ3.14.66.F11.1.454.light.4.raw
cgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatgccaaaggagacggcctcggaagctattatgcaagctggtaccagcagaagccaggacaggcccctgtacttgtcatctatggtaaaaaacatccggccctcagggatcccagaccgattctctggctccaactcaggaaaacacagcttccttgaccatcactggggctcaggcggaagaatgaggctgactattactgtaatccgggtacacgcagtgctaaccccaactaattagtcttcggtaactacggaccgaacggtacgaccgtcctacggtcgaacgccgaacgaccgaacccaa

SEQ ID NO: 560048 - DNA, 491 bp, Homo sapiens
  misc_feature: HIJSMM301CUIWT.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcagggtacactctggccgttcacttttggccaggggaccaaactcggatatcagacgaactgtggctgca

SEQ ID NO: 560049 - DNA, 488 bp, Homo sapiens; identical to SEQ ID NO: 536554
  misc_feature: HIJSMM301CE02U.26.37.D04.1.454.light.4.raw

SEQ ID NO: 560050 - DNA, 473 bp, Homo sapiens
  misc_feature: HIJSMM301EAP39.12.7.A07.1.454.light.4.raw
atacgacgtacacgaccggtgctcgatttagcacgtgtcgcagggggcaggagtcagacccactcaggacacagcatggacatgagggtccccgctcagctcctggggctcctgctgctctggctcccaggtgccacatgtgccatccagatgacccagtctccatcctccctgtctgcatctataggagacagagtcgccatcagttgccgggcaagtcagtacattagaaatgatttagcctggtatcagcagaaaccagggacagcccctcagctcctgatctatgctgcatccaatttacaaactggggtcccatcaaggttcagcggcagtggatctgcaacagacttcaatctcaccatcagcagcctgcagcctgaagattttgcaatttattactgtctgcaggattacacataccctcgaactgtcggaccgaaggacgaaggtaggaaatacaaacgaactgt

SEQ ID NO: 560051 - DNA, 515 bp, Homo sapiens
  misc_feature: HIJSMM301COJX1.10.26.C04.1.454.light.4.raw
catagtagtgcacgaccggtgctcgattagtctagcgactttgggtttgggggctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtcccgtggacgttcggccaagggaccaaggtggcaatcaaccgaactgtggctgcaccatctgtcttcatcttcccgcca

SEQ ID NO: 560052 - DNA, 518 bp, Homo sapiens
  misc_feature: HIJSMM301ADOWN.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcgtccgaacgggaccgaacggtaggaaagtacaaacgaactacgtaggcgtgtcgaccactctgtcttctactcttccccg

SEQ ID NO: 560053 - DNA, 522 bp, Homo sapiens
  misc_feature: HIJSMM301A0UB4.41.19.B08.1.454.light.4.raw
tctatactatcacgaccggtgctcgatttagtgagtcagtaaggggggggtcgtcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaacccccactgtcactctgttcccgccctcctcat

SEQ ID NO: 560054 - DNA, 495 bp, Homo sapiens
  misc_feature: HIJSMM301AGJ1V.5.23.C01.1.454.light.4.raw
atcagacacgcacgaccggtgctcgatttagtacacgtgattagggattgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtggggtcccatcaaggttcagtggcagtggatctgggacagatttcactctcaccatcagtagtctacaacctgaagattttgcaacttactactgtcaacagagttacgatacccctccgctcactttcggtcggagggaccgaaggtaggaggaatcaaacgaaactagtggctgcaccaat

SEQ ID NO: 560055 - DNA, 508 bp, Homo sapiens
  misc_feature: HIJSMM301A7MD6.49.16.B05.1.454.light.4.raw
agtcgagagacacgaccggtgctcgatttagagctcacgtaagggggtgggtccaggaggcagaactctgggtgtctcaccatggcctggatccctctacttctccccctcctcactctctgcacaggttctgaggcctcctatgagctgacacagccaccctcggtgtcagtgtccccaggacagacggccaggatcacctgttttggagatacgttacgaaaggaatatggtcattggtaccagcagaagacaggccaggcccctgtcttggtggtatataaagacagtgagaggccctcagggatccctgagcgattctctggctccagctcagggacaacagtcacgttgaccatcagtggagtccggccagaggacgaggctgactattactgtcagtccgcagacagcagtggcagttatgtcgtattcggcggagggactacgctgaccgtcctaggtcagcccaaggctgccccctcggtcactctgttcccgccctcct

SEQ ID NO: 560056 - DNA, 476 bp, Homo sapiens
  misc_feature: HIJSMM301AN4Z7.7.76.G10.1.454.light.4.raw
cgtgtctctacacgaccggtgctcgatttagtcactcatacagggggcaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagcccctaaactcctgatctctgctgcatccagtttacaaagtggggtcccatcgcggttcagcggcagtggatatgggacatatttcactctcgccatcagcagcctgcagcctgaagatttgcaacttactattgtcaacaggctaacagtttcccgctcaccttcggcgggggaccaaggtggagatcaacgaactgtggctgcacc

SEQ ID NO: 560057 - DNA, 470 bp, Homo sapiens; identical to SEQ ID NO: 536130
  misc_feature: HIJSMM301AILS5.7.81.H04.1.454.light.4.raw

SEQ ID NO: 560058 - DNA, 484 bp, Homo sapiens; identical to SEQ ID NO: 537878
  misc_feature: HIJSMM301ED2QM.17.34.D01.1.454.light.4.raw

SEQ ID NO: 560059 - DNA, 519 bp, Homo sapiens
  misc_feature: HIJSMM301BO9MO.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggctgccccctcggtcactctgttcccgaccctcctcacg

SEQ ID NO: 560060 - DNA, 497 bp, Homo sapiens
  misc_feature: HIJSMM301B57Y6.22.86.H09.1.454.light.4.raw
acatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgaccgtcctaggtcagcccaaggctgccccctcggtcactctgttcccaccctcctc

SEQ ID NO: 560061 - DNA, 493 bp, Homo sapiens; identical to SEQ ID NO: 535745
  misc_feature: HIJSMM301BRCLN.47.78.H01.1.454.light.4.raw

SEQ ID NO: 560062 - DNA, 485 bp, Homo sapiens; identical to SEQ ID NO: 535606
  misc_feature: HIJSMM301AU4SQ.47.46.E02.1.454.light.4.raw

SEQ ID NO: 560063 - DNA, 469 bp, Homo sapiens
  misc_feature: HIJSMM301A65LB.11.70.G04.1.454.light.4.raw
cgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgcatccactctgcaatcaggggtcccatctcgattcagtggcagtggatctgggacagatttcactctcaccatcagcagcctgcagcctgaagatgttgcaacttattactgtacaaaagaatagcgctgccccgctcaggtttcggcggagggaccaaggtggagatacg

SEQ ID NO: 560064 - DNA, 511 bp, Homo sapiens; identical to SEQ ID NO: 537464
  misc_feature: HIJSMM301DHK4F.7.34.D01.1.454.light.4.raw

SEQ ID NO: 560065 - DNA, 504 bp, Homo sapiens; identical to SEQ ID NO: 542288
  misc_feature: HIJSMM301D32Q9.8.28.C06.1.454.light.4.raw

SEQ ID NO: 560066 - DNA, 486 bp, Homo sapiens; identical to SEQ ID NO: 548935
  misc_feature: HIJSMM301C1GJB.47.38.D05.1.454.light.4.raw

SEQ ID NO: 560067 - DNA, 481 bp, Homo sapiens; identical to SEQ ID NO: 535410
  misc_feature: HIJSMM301EJM0P.41.68.G02.1.454.light.4.raw

SEQ ID NO: 560068 - DNA, 495 bp, Homo sapiens; identical to SEQ ID NO: 539267
  misc_feature: HIJSMM301EOPSQ.21.27.C05.1.454.light.4.raw

SEQ ID NO: 560069 - DNA, 509 bp, Homo sapiens
  misc_feature: HIJSMM301BF0KI.15.34.D01.1.454.light.4.raw
tctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacggggcccaggcagacgatgaatgtgattatcactgcgtcctttatgtgggcgtggcatttgggtgttcggcggagggaccaaactgaccgtcctaggtcagcccaaggctgccccctcggtcactctcg

SEQ ID NO: 560070 - DNA, 509 bp, Homo sapiens
  misc_feature: HIJSMM301C8SN0.40.53.E09.1.454.light.4.raw
tctagcgactcacgaccggtgctcgatttagagagagtgtgttgggtttggggggtagagaagacaggactcaggacaatctccagcatggccagcttccctctcctcctcaccctcctcactcactgtgcagggtcctgggcccagtctgtgctgactcagccaccctcagcgtctgggacccccggtcagagggtcaccatctcttgttctggaagcagatccaacatcggaagtaatactgtaaactggtaccagcagctcccaggaacggcccccaaactcctcatctatgataatagtcaccggccctcaggggtacctgaccgattctctggctccaagtctggcacctcagcctccctggccatcagtgggctccagtctgaggatgaggctgattatcactgtgcatcctgggatgacagcctgaatggttgggtgttcggcggggggaccaaggctgaccgtcctaagtcagcccaaggctgccccctcggtcactctcg

SEQ ID NO: 560071 - DNA, 354 bp, Homo sapiens; identical to SEQ ID NO: 535026
  misc_feature: HIJSMM301DH4HX.19.22.B11.1.454.light.4.raw

SEQ ID NO: 560072 - DNA, 484 bp, Homo sapiens; identical to SEQ ID NO: 538870
  misc_feature: HIJSMM301E0LQ5.11.76.G10.1.454.light.4.raw

SEQ ID NO: 560073 - DNA, 501 bp, Homo sapiens; identical to SEQ ID NO: 535873
  misc_feature: HIJSMM301CTY8T.17.27.C05.1.454.light.4.raw

SEQ ID NO: 560074 - DNA, 478 bp, Homo sapiens; identical to SEQ ID NO: 541928
  misc_feature: HIJSMM301A7Z32.7.76.G10.1.454.light.4.raw

SEQ ID NO: 560075 - DNA, 499 bp, Homo sapiens
  misc_feature: HIJSMM301DCNGY.10.9.A09.1.454.light.4.raw
catagtagtgcacgaccggtgctcgatttagcgagacgcgcaggggcagagccctggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccggggccacttcggccctgggaccaaagtggagatcaacgaactgtggctgcacca

SEQ ID NO: 560076 - DNA, 485 bp, Homo sapiens
  misc_feature: HIJSMM301EJSW9.3.34.D01.1.454.light.4.raw
agacgcactccacgaccggtgctcgatttagatcgtctgtgttgggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaagctatatgcttactggtaccagcagaagccaggccaggcccctgtggtggtgatatataaagaccgtgagaggccctcagggatccctgagcgaatctctggctccagctcagggacaacagtcacgttgaccatcagtggagtccaggcagaagacgaggctgactatcactgtcaaatagcagacagcaatggaacccatagggctgtggtgttcggcggagggaccaagctgaccgtcctaagtcacg

SEQ ID NO: 560077 - DNA, 506 bp, Homo sapiens
  misc_feature: HIJSMM301AKITT.18.59.F04.1.454.light.4.raw
tacgagtatgcacgaccggtgctcgatttagtacacacacttagggattggggggggtcgtcaggaggcagcgctctcgggacggtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagccccaaggccaaccccc

SEQ ID NO: 560078 - DNA, 493 bp, Homo sapiens
  misc_feature: HIJSMM301EAYYO.16.6.A06.1.454.light.4.raw
tgtactactccacgaccggtgctcgatttagatctactgacagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagcttggtaccagcagaaaccggggcagtctcctaagttgctcatttactgggcgtctacccgggaatccggggtccctgaccgattcagtggcagcgggtctgggacagatttcactctcaccatcagcagcctgcaggttgaagatgtggcagtttattactgtcagcagtattatactactcctctgacgttggccaagggaccaaggtggagatcaaacgaactgtggctgcaccat

SEQ ID NO: 560079 - DNA, 514 bp, Homo sapiens; identical to SEQ ID NO: 539814
  misc_feature: HIJSMM301BUB7J.16.88.H11.1.454.light.4.raw

SEQ ID NO: 560080 - DNA, 512 bp, Homo sapiens
  misc_feature: HIJSMM301EMMRU.14.3.A03.1.454.light.4.raw
cgtctagtaccacgaccggtgctcgatttagagagcgtcacaggggggggtcgtcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggttattataattttgtctcctggtaccaacagcacccaggcaaagcccccaaactcattatttatgaggtcaataatcggccctcaggagtttctaatcgcttctctggctccaagtctggcaacacggcctccctgagcatctctgggctccaggctgaggacgaggctgattattactgcagctcatatactattagcagaactgtggttttcggcggagggaccaaggtgaccgtcctaggtcagcccaaggctgccccctcggtcactctgttccccg

SEQ ID NO: 560081 - DNA, 489 bp, Homo sapiens; identical to SEQ ID NO: 553430
  misc_feature: HIJSMM301BYJFB.14.55.E11.1.454.light.4.raw

SEQ ID NO: 560082 - DNA, 479 bp, Homo sapiens
  misc_feature: HIJSMM301BSAG5.13.5.A05.1.454.light.4.raw
tcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagactggaacctgaagactttgcactttattctgtcaccagtatggaactgtggctgcacatctgtcttcatcttcccgccatctgatagtacgtga

SEQ ID NO: 560083 - DNA, 493 bp, Homo sapiens; identical to SEQ ID NO: 556851
  misc_feature: HIJSMM301AIZHF.52.10.A10.1.454.light.4.raw

SEQ ID NO: 560084 - DNA, 496 bp, Homo sapiens
  misc_feature: HIJSMM301CGTSE.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggaggaccaaggtggagatcaaacgaactgtggctgcaccatctgtcttcatcttcccgccatctgac

SEQ ID NO: 560085 - DNA, 444 bp, Homo sapiens; identical to SEQ ID NO: 535192
  misc_feature: HIJSMM301EBP8M.5.9.A09.1.454.light.4.raw

SEQ ID NO: 560086 - DNA, 508 bp, Homo sapiens
  misc_feature: HIJSMM301DCSL6.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccggggccactttcggcccgtggaccaaagtggatatacaaacgaactgtggctgcaccatctgtcttcta

SEQ ID NO: 560087 - DNA, 484 bp, Homo sapiens
  misc_feature: HIJSMM301C8XRP.17.34.D01.1.454.light.4.raw
cgtagactagcacgaccggtgctcgatttagatcgtctgtgttgggtttgggtcatcacaatatctgcactggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggcccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttcctccgacgttcggccaaggaccaaggtggaactcaaacgaactgtggctgcaccatctgtcttcatcttcccgccatctgactagtctacg

SEQ ID NO: 560088 - DNA, 470 bp, Homo sapiens; identical to SEQ ID NO: 536130
  misc_feature: HIJSMM301ELLP2.7.81.H04.1.454.light.4.raw

SEQ ID NO: 560089 - DNA, 539 bp, Homo sapiens
  misc_feature: HIJSMM301EIVVZ.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaaggtgggaccctaacgaaacgaacgtggtcggtcgtcgccaactcttcgtcgtttctactacttcccgttccccgtactacttcg

SEQ ID NO: 560090 - DNA, 441 bp, Homo sapiens; identical to SEQ ID NO: 534971
  misc_feature: HIJSMM301D557R.11.3.A03.1.454.light.4.raw

SEQ ID NO: 560091 - DNA, 498 bp, Homo sapiens; identical to SEQ ID NO: 552428
  misc_feature: HIJSMM301AN82W.10.65.F10.1.454.light.4.raw

SEQ ID NO: 560092 - DNA, 511 bp, Homo sapiens
  misc_feature: HIJSMM301B475Y.7.34.D01.1.454.light.4.raw
cgtgtctctacacgaccggtgctcgatttagatcgtctgtgttgggtttgggggggtcgtcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggactccagactgaggacgaggctgattattactgctgctcatatacaggggacagcattatttgggtgttcggcggagggaccaagctgaccgtcctgcgtcagcccaaggctgccccctcggtcact

SEQ ID NO: 560093 - DNA, 505 bp, Homo sapiens; identical to SEQ ID NO: 554737
  misc_feature: HIJSMM301CRWXQ.40.67.G01.1.454.light.4.raw

SEQ ID NO: 560094 - DNA, 505 bp, Homo sapiens
  misc_feature: HIJSMM301A8AI6.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcgggcggagggaccaaggtggacctcaaacgaactgtggctgcaccatctgtcttcatcttcccgc

SEQ ID NO: 560095 - DNA, 508 bp, Homo sapiens
  misc_feature: HIJSMM301CUXA0.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggccaagttgaccgtcctaggtcagcccaaggctgccccctcggtcactctgtt

SEQ ID NO: 560096 - DNA, 490 bp, Homo sapiens; identical to SEQ ID NO: 541567
  misc_feature: HIJSMM301ATA9F.22.65.F10.1.454.light.4.raw

SEQ ID NO: 560097 - DNA, 494 bp, Homo sapiens; identical to SEQ ID NO: 534994
  misc_feature: HIJSMM301D35Y1.27.78.H01.1.454.light.4.raw

SEQ ID NO: 560098 - DNA, 471 bp, Homo sapiens
  misc_feature: HIJSMM301C3275.49.4.A04.1.454.light.4.raw
agtcgagagacacgaccggtgctcgatttagagtagtgatcaggggagtcccaaccaggacacagcatggacatgagggtccctgctcagctcctggggctcctgctgctctggctctcaggtgccagatgtgtcatccagatgacccagtctccttcctccctgtctgcatctataggagacagaatcaccatcacttgccgggcgagtcgagacattagcatgtatctgaattggtatcagcaaaaaccagggacagcccctaaactcctgatcctcgatgcatccactttggagacaggggtcccatcaaggttcagtggaagtggctctgggacagattttactttcaccatcagcaggctgcagcctgaagatattgcaacatattactgtcaacagtatgatcgcctcccgctcactttcggcgggggaccaaggtggagatcaagcgaactgtggctggcacca

SEQ ID NO: 560099 - DNA, 488 bp, Homo sapiens; identical to SEQ ID NO: 535861
  misc_feature: HIJSMM301D10FL.14.55.E11.1.454.light.4.raw

SEQ ID NO: 560100 - DNA, 503 bp, Homo sapiens; identical to SEQ ID NO: 546358
  misc_feature: HIJSMM301C62BH.16.9.A09.1.454.light.4.raw

SEQ ID NO: 560101 - DNA, 485 bp, Homo sapiens
  misc_feature: HIJSMM301C49D7.41.10.A10.1.454.light.4.raw
tctatactatcacgaccggtgctcgatttagcgtcgatctcaggggcatgagcaagactgacaagtcaaggcaggaagatgttgccatcacaactcattgggtttctgctgctctgggttccagcctccaggggtgaaattgtgctgactcagtctccaggctttcagtctgtgactccaaaggagaaagtcaccatcacctgccgggccagtcagagcattgatagtgatttacactggtaccagcagaaaccaaatcagtctccaaagctcctcatcaagtattcttcccagtccatctcaggggtcccctcgaggttcagtggcagtggatctgggacagatttcaccctcaccatcagtagcctggaagctgaagatgctgcaacgtattactgtcatcagagtcgtagtttacctcaaacgttcggccaagggaccaaggtggaaatcaaacgaactgtggctgcaccatctgtcttcat

SEQ ID NO: 560102 - DNA, 479 bp, Homo sapiens
  misc_feature: HIJSMM301BHV7R.7.67.G01.1.454.light.4.raw
cgtgtctctacacgaccggtgctcgatttagagtatacatattgggtttgggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctcccacagcggggcaggttctcatgttcactggtaccagcagcttccagggacagcccccaaactcctcatatacgagaacaccaatcggccctcaggagtccctgaccgattctctggctccaagtctggcacctcagcctccctggccatcactgggctccaggctgaggatgaggctgattattactgccagtcgtatgacagcagcctgagtgtttgggtgttcggcggagggacc

SEQ ID NO: 560103 - DNA, 486 bp, Homo sapiens; identical to SEQ ID NO: 550553
  misc_feature: HIJSMM301EGK7L.46.35.D02.1.454.light.4.raw

SEQ ID NO: 560104 - DNA, 506 bp, Homo sapiens; identical to SEQ ID NO: 540748
  misc_feature: HIJSMM301BW8TZ.18.37.D04.1.454.light.4.raw

SEQ ID NO: 560105 - DNA, 484 bp, Homo sapiens; identical to SEQ ID NO: 535400
  misc_feature: HIJSMM301AEJ6Y.46.26.C04.1.454.light.4.raw

SEQ ID NO: 560106 - DNA, 496 bp, Homo sapiens
  misc_feature: HIJSMM301ECCM9.16.6.A06.1.454.light.4.raw
tgtactactccacgaccggtgctcgatttagatctactgacagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagcttggtaccagcagaaaccggggcagtctcctaagttgctcatttactgggcgtctacccgggaatccggggtccctgaccgattcagtggcagcgggtctgggacagatttcactctcaccatcagcagcctgcaggttgaagatgtggctagtttattactgtcagcagtattatactactcctctgacgttcggaccaagggaccaaggtggagatcaaacgaactgtggctgccacat

SEQ ID NO: 560107 - DNA, 485 bp, Homo sapiens
  misc_feature: HIJSMM301A6UQX.7.81.H04.1.454.light.4.raw
cgtgtctctacacgaccggtgctcgatttagtagtgtagattcgcgggggagtcagtctcagtcaggacacagcatggacatgagggtccccgcctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaactacactttcggtccctcgggacgtgagtagcatatgaagaagaactagtggcgtgca

SEQ ID NO: 560108 - DNA, 484 bp, Homo sapiens; identical to SEQ ID NO: 537878
  misc_feature: HIJSMM301CDURS.17.34.D01.1.454.light.4.raw

SEQ ID NO: 560109 - DNA, 444 bp, Homo sapiens
  misc_feature: HIJSMM301DZKOV.10.76.G10.1.454.light.4.raw
catagtagtgcacgaccggtgctcgatttagtcactcatacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatggggctgattattactgccactcctatgacaacagcctgagtatttggctgttcggcggcgggaccaagttgaccgtcctacgtcagcccaaggctgccccctcggtcactctgttcccgccctcctccactactatg

SEQ ID NO: 560110 - DNA, 508 bp, Homo sapiens; identical to SEQ ID NO: 536388
  misc_feature: HIJSMM301EQ1WI.11.57.F02.1.454.light.4.raw

SEQ ID NO: 560111 - DNA, 441 bp, Homo sapiens; identical to SEQ ID NO: 535074
  misc_feature: HIJSMM301CS3F0.11.3.A03.1.454.light.4.raw

SEQ ID NO: 560112 - DNA, 493 bp, Homo sapiens; identical to SEQ ID NO: 535084
  misc_feature: HIJSMM301D08RZ.47.64.F09.1.454.light.4.raw

SEQ ID NO: 560113 - DNA, 489 bp, Homo sapiens; identical to SEQ ID NO: 535139
  misc_feature: HIJSMM301C3NF3.14.55.E11.1.454.light.4.raw

SEQ ID NO: 560114 - DNA, 495 bp, Homo sapiens
  misc_feature: HIJSMM301C8QLS.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcggccaagggaccaaggtggaaatcaaacgaactgtggctgcacc

SEQ ID NO: 560115 - DNA, 494 bp, Homo sapiens; identical to SEQ ID NO: 534994
  misc_feature: HIJSMM301DJGBU.27.78.H01.1.454.light.4.raw

SEQ ID NO: 560116 - DNA, 491 bp, Homo sapiens; identical to SEQ ID NO: 535194
  misc_feature: HIJSMM301EVV82.26.78.H01.1.454.light.4.raw

SEQ ID NO: 560117 - DNA, 463 bp, Homo sapiens
  misc_feature: HIJSMM301AJVR8.11.73.G07.1.454.light.4.raw
cgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctgatctacgatgcgtccaatttggaaacagaggccccaccgaggttcagtggaagtggatctgggacagactttactctcaccatcagcagcctgcagcctgaagatattgcaacatattactgtcaacagtatgatcgtctcctcaatttcggccctgggaccagagtggacatgaaacgaa

SEQ ID NO: 560118 - DNA, 447 bp, Homo sapiens; identical to SEQ ID NO: 535882
  misc_feature: HIJSMM301A7VFJ.18.9.A09.1.454.light.4.raw
  modified_base (429)..(429): a, c, t, g, unknown or other

SEQ ID NO: 560119 - DNA, 506 bp, Homo sapiens; identical to SEQ ID NO: 539926
  misc_feature: HIJSMM301CTPEM.5.24.C02.1.454.light.4.raw

SEQ ID NO: 560120 - DNA, 454 bp, Homo sapiens; identical to SEQ ID NO: 535005
  misc_feature: HIJSMM301DLKLI.19.86.H09.1.454.light.4.raw

SEQ ID NO: 560121 - DNA, 486 bp, Homo sapiens; identical to SEQ ID NO: 535043
  misc_feature: HIJSMM301BXWMW.46.35.D02.1.454.light.4.raw

SEQ ID NO: 560122 - DNA, 500 bp, Homo sapiens
  misc_feature: HIJSMM301ASN4Z.9.81.H04.1.454.light.4.raw
tgatacgtctcacgaccggtgctcgatttagtagtgtagattcgcggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtgcttataactatgtctcctggtaccaacagcacccaggcaaagtccccaaactcatgatttatgaggtcaataagcggccctctggggtccctgatcgcttctctggctccaagtctggcaacacggcctccctgaccgtctctgggctccaggctgacgatgaggctgattattactgcagctcatatgcaggcacccacaatgtcttcggaagtgggaccacggtcaccgtcctaggtcagcccaaggccaacccactgtcact

SEQ ID NO: 560123 - DNA, 484 bp, Homo sapiens
  misc_feature: HIJSMM301CPMH6.46.78.H01.1.454.light.4.raw
  modified_base (433)..(433): a, c, t, g, unknown or other
actagcagtacacgaccggtgctcgatttagtgtgagtagtttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctntacaagtcccgctcactttcggcggagggaccaaggtggagatcaaacgaa

SEQ ID NO: 560124 - DNA, 472 bp, Homo sapiens; identical to SEQ ID NO: 536302
  misc_feature: HIJSMM301DC676.18.76.G10.1.454.light.4.raw

SEQ ID NO: 560125 - DNA, 498 bp, Homo sapiens
  misc_feature: HIJSMM301C8I62.22.86.H09.1.454.light.4.raw
acatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaggatgaggctgattattactgctactcatatgcaggcggcaactcttgggtgttcggcggagggaccaagctgaccgtcctaggtcagcccaaggctgccccctcggtcactctgttcccaccctcctcc

SEQ ID NO: 560126 - DNA, 478 bp, Homo sapiens
  misc_feature: HIJSMM301DQMVX.52.26.C04.1.454.light.4.raw
cgcagtacgacacgaccggtgctcgatttagtctagcgactttgggtttggggctgggcctcaggaagcagcatcggaggtgcctcagccatggcatggatccctctcttcctcgacgtccttgcttactgcacaggatccgtggcctcctatgagctgactcagccacactcagtgtccgtgtccccaggacagacagccagcatcacctgctctggagatgaattggggaataaatttgcttgctggtatcaccagaagccaggccagtcccctgtcctggtcatctatcaagatgtcaagcggccctcagggatccctgagcgattctctggctccaactctgggaacacagccactctgaccatcagcgggacccaggctatggatgaggctgactattactgtcaggcgtgggacagcaacactgtggtattcggcggagggaccaagctgaccgtcctaggtcagcccaagg

SEQ ID NO: 560127 - DNA, 500 bp, Homo sapiens
  misc_feature: HIJSMM301EDULH.13.10.A10.1.454.light.4.raw
tcacgtactacacgaccggtgctcgatttagcgtcgatctcagggggggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatctacaacacaaacactcgctcttctggggtccctcatcgcttctctggctccatccttgggaacaaagctgcccttatcatcacgggggcccaggcagaagatgaatctgattattactgtgttctttatatgggtagtgccatttctgcttgtgttcggaggaggcacccggcctgacccgtcctcggtcagcccaaggctgcccc

SEQ ID NO: 560128 - DNA, 490 bp, Homo sapiens; identical to SEQ ID NO: 535936
  misc_feature: HIJSMM301AFI5R.16.68.G02.1.454.light.4.raw

SEQ ID NO: 560129 - DNA, 494 bp, Homo sapiens; identical to SEQ ID NO: 539894
  misc_feature: HIJSMM301D33ZL.16.53.E09.1.454.light.4.raw

SEQ ID NO: 560130 - DNA, 495 bp, Homo sapiens
  misc_feature: HIJSMM301EUCT6.7.67.G01.1.454.light.4.raw
cgtgtctctacacgaccggtgctcgatttagagtatacatattgggtttgggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctcccacagcggggcaggttctgatgttcactggtaccagcagcttccagggacagcccccaaactcctcatatacgagaacaccaatcggccctcaggagtccctgaccgattctctggctccaagtctggcacctcagcctccctggccatcacgtgggctccaggctgaggatgaggctgattattactgccacgtcgtatgacagcagcccggagttggtttgggttggttcgggacggggacggaccgaacg

SEQ ID NO: 560131 - DNA, 487 bp, Homo sapiens
  misc_feature: HIJSMM301AFZZM.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgataactacttagcctggttgcagtcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaaacgaactgtggctgcaccat

SEQ ID NO: 560132 - DNA, 488 bp, Homo sapiens
  misc_feature: HIJSMM301BIF5M.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactaattcggcggagggaccaagctgaccgtcctgcgtcagcccaaggctgccccctcggtcactctgttcccaccctccctccgctacgtaga

SEQ ID NO: 560133 - DNA, 493 bp, Homo sapiens
  misc_feature: HIJSMM301BYY2T.14.5.A05.1.454.light.4.raw
cgtctagtaccacgaccggtgctcgatttagatagatagacaggggggaactgctcagttaggacccagagggaaccatggaagccccagctcagcttctcttcctcctgctactctggctcccagataccaccggagaaattgtgttgacacagtctccaggcaccctgtccttgtctccaggggaaagagccaccctctcctgcagggccagtcagagtgttgatacgtacttagcctggtaccaacagaaacctggccaggctcccaggctcctcatctatgatgcatccatcagggccactggcatcccagccaggttcagtggcagtgggtctgggacagacttcactctcaccatcagcagcctagagcctgaagattttgcagtttattactgtcagcagcgtaccaactggcctcctgcgctcactttcggcggagggaccaaggtggaggatcaaacgaactgtggctgcaccatctgtcttca

SEQ ID NO: 560134 - DNA, 488 bp, Homo sapiens; identical to SEQ ID NO: 543314
  misc_feature: HIJSMM301ALQUO.3.33.C11.1.454.light.4.raw

SEQ ID NO: 560135 - DNA, 497 bp, Homo sapiens; identical to SEQ ID NO: 549756
  misc_feature: HIJSMM301D0AR5.40.57.F02.1.454.light.4.raw

SEQ ID NO: 560136 - DNA, 486 bp, Homo sapiens; identical to SEQ ID NO: 535385
  misc_feature: HIJSMM301E1EJG.19.71.G05.1.454.light.4.raw

SEQ ID NO: 560137 - DNA, 486 bp, Homo sapiens
  misc_feature: HIJSMM301BI84Z.47.78.H01.1.454.light.4.raw
agctcacgtacacgaccggtgctcgatttagtgtgagtagtttgggtttgggaacctatgaacattctgtaggggccactgtcttctccacggtgctcccttcatgcgtgactcagccaccctcagcgtctgggacccccgggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcagcctccctggcccatcagtgggctccggtccgaggatgaggctgattattattgtgcaacatgggatagtagcctgagtagtgtggttttcggcggagggaccaaactgaccgtcctaggtcagcccaaggctgccccctcggtcactctgttcccgccctcctctacgtgagct

SEQ ID NO: 560138 - DNA, 453 bp, Homo sapiens
  misc_feature: HIJSMM301D8SLI.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggccaagctgaccgtcctaagtcagcgcaaggctgccccctcggtcactctgttcccgccctcctccacgagagta

SEQ ID NO: 560139 - DNA, 508 bp, Homo sapiens; identical to SEQ ID NO: 536388
  misc_feature: HIJSMM301BAGSC.11.57.F02.1.454.light.4.raw

SEQ ID NO: 560140 - DNA, 485 bp, Homo sapiens; identical to SEQ ID NO: 538533
  misc_feature: HIJSMM301EK74W.47.78.H01.1.454.light.4.raw

SEQ ID NO: 560141 - DNA, 487 bp, Homo sapiens; identical to SEQ ID NO: 537208
  misc_feature: HIJSMM301B4MX0.3.55.E11.1.454.light.4.raw

SEQ ID NO: 560142 - DNA, 486 bp, Homo sapiens; identical to SEQ ID NO: 535043
  misc_feature: HIJSMM301D3C71.46.35.D02.1.454.light.4.raw

SEQ ID NO: 560143 - DNA, 496 bp, Homo sapiens
  misc_feature: HIJSMM301ASFUF.17.43.D10.1.454.light.4.raw
cgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacgagccaccctctcctgcagggccagtcagagtgtgagcagcaacttagcctggtatcagcagaaacctggccaggctcccaggctcctcatctatggtgcttccaccagggccgctggtgtcccagccagattcaggggcagtgggtctgggacagagttcactctcaccatcagcagcctgcagtctgaagattttgcagtttattactgtcagcactataataactggcccccggggggacgttcggccaagggaccaaggtggagatcaaacgaactgtggctgcaccatctgtcttcatcc

SEQ ID NO: 560144 - DNA, 492 bp, Homo sapiens; identical to SEQ ID NO: 534967
  misc_feature: HIJSMM301C78KE.47.64.F09.1.454.light.4.raw

SEQ ID NO: 560145 - DNA, 496 bp, Homo sapiens; identical to SEQ ID NO: 535109
  misc_feature: HIJSMM301EBNET.16.78.H01.1.454.light.4.raw

SEQ ID NO: 560146 - DNA, 474 bp, Homo sapiens
  misc_feature: HIJSMM301C644K.12.49.E05.1.454.light.4.raw
  modified_base (437)..(437): a, c, t, g, unknown or other
atacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagcaattttttagcctggtatcagcagaaaccagggaaagttccacacctcctgatctatgctgcatccgctttgcaatcagggtcccatctcggttcagcggcagtggatctgggacagagttcactctcaccatcagcagcctgcagcctgaagatgttgcaacttattactgtcaaaagtataacagtgcccccttnacccttcggccaagggacacgactggagattagaacg

SEQ ID NO: 560147 - DNA, 519 bp, Homo sapiens
  misc_feature: HIJSMM301BRI1G.48.34.D01.1.454.light.4.raw
agtatacatacacgaccggtgctcgatttagatcgtctgtgttgggtttgggggctgtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaattgaagtcaggccaggcccctgtcctggtcatttatgaggacgaccagcgaccctccaggatccctgcgaggttctctggatcgaactcagggacattggccaccttgactatcacgtggggcccaggtggaggatgaaggtgactacttctgtttctcaacagacaccagtgacaatcatgcgagttttcggcgggagggaccaagctgaccgtcctgggtcacgcccaaggctcgccccctcggtcactctcgttcccccg

SEQ ID NO: 560148 - DNA, 505 bp, Homo sapiens; identical to SEQ ID NO: 539978
  misc_feature: HIJSMM301DRYKB.5.86.H09.1.454.light.4.raw

SEQ ID NO: 560149 - DNA, 384 bp, Homo sapiens
  misc_feature: HIJSMM301A7ZS3.48.34.D01.1.454.light.4.raw
agtatacatacacgaccggtgctcgatttagatcgtctgtgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcacca

SEQ ID NO: 560150 - DNA, 485 bp, Homo sapiens; identical to SEQ ID NO: 535880
  misc_feature: HIJSMM301AG52W.7.75.G09.1.454.light.4.raw

SEQ ID NO: 560151 - DNA, 514 bp, Homo sapiens
  misc_feature: HIJSMM301EAHS5.48.66.F11.1.454.light.4.raw
agtatacatacacgaccggtgctcgatttagtcacgcgagaaaggggggaagcctgagaacacttagccttcatgagtgtccccaccatggcctggatgatgcttctcctcggactccttgcttatggatcaggcgtgcattctcagagtgtggtgacccaggaaccatcgttctcagtgtcccctggagggacagtcacactcacttgtggcttgacttctggctcagtcgcgccggtccactaccccagttggtaccaacagatcccaggccaggctccacgcacgctcatcttcatgaaacagattcgctcttctggggtccctgatcggttttctggctccatcgttggggcaaagccgccctcaccatcacgggggcccaggcagaggatgaggcgaattattattgtatgctccacaggggcaggggcacctgggagttcggcggcgggaccaagctgaccgtcctaggtcagcccaaggctcgccccgtcggtcactctcgttcccg

SEQ ID NO: 560152 - DNA, 474 bp, Homo sapiens
  misc_feature: HIJSMM301EUP2N.12.49.E05.1.454.light.4.raw
atacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagcaattttttagcctggtatcagcagaaaccagggaaagttccacacctcctgatctatgctgcatccgctttgcaatcaggggtcccatctcggttcagcggcagtggatctgggacagagttcactctcaccatcagcagcctgcagcctgaagatgttgcaacttattactgtcaaaagtataacagtgcccccttcaccttcggcccaagggacacgactggagattagacg

SEQ ID NO: 560153 - DNA, 490 bp, Homo sapiens
  misc_feature: HIJSMM301CDRSX.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccggaccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtggaggtcaaacgaactgtggctgcaccatctgtcttcat

SEQ ID NO: 560154 - DNA, 494 bp, Homo sapiens; identical to SEQ ID NO: 536444
  misc_feature: HIJSMM301BZU84.26.72.G06.1.454.light.4.raw

SEQ ID NO: 560155 - DNA, 514 bp, Homo sapiens
  misc_feature: HIJSMM301C44U6.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttgaagcagccgatccagcctgcggagcctgtggggcaggtcagcccaaggctgcccctcggtcactctgtcccacctcctccacg

SEQ ID NO: 560156 - DNA, 528 bp, Homo sapiens
  misc_feature: HIJSMM301CJ7QN.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcggtccgaacggaccgaacggtaggaaggtacgaaacgaactagtggcgtgcaccactctcgttcttactctccttcccgtcctactctacgt

SEQ ID NO: 560157 - DNA, 504 bp, Homo sapiens; identical to SEQ ID NO: 539690
  misc_feature: HIJSMM301B5WIE.47.65.F10.1.454.light.4.raw

SEQ ID NO: 560158 - DNA, 482 bp, Homo sapiens; identical to SEQ ID NO: 538815
  misc_feature: HIJSMM301DHNHI.4.34.D01.1.454.light.4.raw

SEQ ID NO: 560159 - DNA, 492 bp, Homo sapiens
  misc_feature: HIJSMM301C5YIM.46.67.G01.1.454.light.4.raw
actagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatctgggacagatttcactctcaccatcagtaatctgcaacgtgaagattttgcaacttattactgtcaacagaattacaatgttttcggccaagggacacgactacaaattaaacgaactagtggctgcaccatctgtcttcatcttcccgccat

SEQ ID NO: 560160 - DNA, 503 bp, Homo sapiens
  misc_feature: HIJSMM301CCA8A.5.24.C02.1.454.light.4.raw
  modified_base (206)..(206): a, c, t, g, unknown or other
atcagacacgcacgaccggtgctcgatttagtacagatcgttagggaaagggggctggggtctcaggaggcagcgctctcaggacgtcaccaccatggcctgggctctgctcctcctcaccctcctcactcagggcacagggtcctgggcccaggctgccctgactcagcctccctccgtgtccgggtctcctggacagtcagtcnccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaagctgaccgtcctaggtcagcccaaggccg

SEQ ID NO: 560161 - DNA, 507 bp, Homo sapiens
  misc_feature: HIJSMM301ERQSE.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattctgcagtttattactgtcaacagcgtagcagcaggcctccggcgacgttcggccaaggaccaaggtggaagtcaagcgaactgtggctgcaccatctgtcttcatcttcccgcc

SEQ ID NO: 560162 - DNA, 501 bp, Homo sapiens; identical to SEQ ID NO: 542364
  misc_feature: HIJSMM301DIYYY.7.71.G05.1.454.light.4.raw

SEQ ID NO: 560163 - DNA, 500 bp, Homo sapiens
  misc_feature: HIJSMM301AYG2A.41.14.B03.1.454.light.4.raw
tctatactatcacgaccggtgctcgatttagtgtgagtagttccgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggagggaccaagctgaccgtcctaggtcagtccaaggctgccccctc

SEQ ID NO: 560164 - DNA, 501 bp, Homo sapiens
  misc_feature: HIJSMM301BCDO4.5.86.H09.1.454.light.4.raw
atcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaagctgaccgtcctaggtcagcccatggctgccccccg

SEQ ID NO: 560165 - DNA, 514 bp, Homo sapiens
  misc_feature: HIJSMM301AFXM2.22.36.D03.1.454.light.4.raw
acatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaacccccccaactcatcatttatggtgtcactcgtcggccctcaggagtctctcatcgcttctcaggctccaagtctggcaacacggcctcctaaccatctctgggctccagtttgaggacgagtctacttattactgcagttcctttaaattaggcgccactctcgtggttttcggcggaggcaccgaagtgaccgtcctcggtcagcccaaggctcgccccctcggtcactc

SEQ ID NO: 560166 - DNA, 422 bp, Homo sapiens; identical to SEQ ID NO: 447881
  misc_feature: HIJSMM301BO3Q0.9.34.D01.1.454.light.4.raw

SEQ ID NO: 560167 - DNA, 479 bp, Homo sapiens; identical to SEQ ID NO: 537163
  misc_feature: HIJSMM301BZKL5.13.73.G07.1.454.light.4.raw

SEQ ID NO: 560168 - DNA, 507 bp, Homo sapiens; identical to SEQ ID NO: 545328
  misc_feature: HIJSMM301CCI4G.8.33.C11.1.454.light.4.raw

SEQ ID NO: 560169 - DNA, 476 bp, Homo sapiens
  misc_feature: HIJSMM301EP0AF.12.1.A01.1.454.light.4.raw
atacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaaggttcagtggcagtgggtctgggacagatttcactctcaccatcagcagtctgcaacctgaagattctgcaacttattactgtcaacagagtaacagttaccctccactttcggcggagggaccaaggtggagatcaaacgaactgtggctgcaccatctgtt

SEQ ID NO: 560170 - DNA, 512 bp, Homo sapiens
  misc_feature: HIJSMM301BA96T.19.59.F04.1.454.light.4.raw
tactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggaagaatttttgtgtcctggtaccagcagctcccaggaacagcccccaaactcctcatttttgacaataataagcgaccctcagggattcctgaccgattctctggctccaagtctggcacgtcagccaccctgggcatcaccggactccagactgggggacgaggccgattattactgcggaacatgggatagcagcctgagtactgtgataatcggcggagggaccaagctgaccgtcctaggtcagcccaaggctgccccctcggtcactctgttccca

SEQ ID NO: 560171 - DNA, 482 bp, Homo sapiens; identical to SEQ ID NO: 535216
  misc_feature: HIJSMM301EORR8.17.26.C04.1.454.light.4.raw

SEQ ID NO: 560172 - DNA, 497 bp, Homo sapiens; identical to SEQ ID NO: 543765
  misc_feature: HIJSMM301AFU4N.51.80.H03.1.454.light.4.raw

SEQ ID NO: 560173 - DNA, 487 bp, Homo sapiens
  misc_feature: HIJSMM301B5VP3.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtaccccgtacacttttggccagggaccaaactggacatcaaacgaactgtggctgcaccatctgtt

SEQ ID NO: 560174 - DNA, 493 bp, Homo sapiens
  misc_feature: HIJSMM301ADBLL.22.73.G07.1.454.light.4.raw
acatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagtctggtaccagcagagacctggccaggctcccaggctcctcatctatggtgcttctaccagggccactggtatccccgccaggttcagtgccagtgggtctgggacagagttcactctcaccatcagcagcctgcagtctgaagattttgcactttattactgtcagcaatataatgactggttctcgatcaccttcgccaaggacgacgactagagattaaacgtaactagtggtctcgcaccactactcgtt

SEQ ID NO: 560175 - DNA, 507 bp, Homo sapiens; identical to SEQ ID NO: 535930
  misc_feature: HIJSMM301D14V4.15.34.D01.1.454.light.4.raw

SEQ ID NO: 560176 - DNA, 523 bp, Homo sapiens
  misc_feature: HIJSMM301ALRHK.22.36.D03.1.454.light.4.raw
  modified_base (485)..(485): a, c, t, g, unknown or other
acatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaaccccccaactcatcattatggtgtcactcgtcggcctcaggagtctctcatcgcttctcaggctccaagtctggcaacacggcctccctaaccatctctgggctccagtttgaggacgagtctacttattactgcagttcctttaaattaggcgccactctcgtggttttcggcggaggcaccgaagtgaccgtccttcggtcngacccaacggctcgcccccctcgggtcaccttcttccg

SEQ ID NO: 560177 - DNA, 468 bp, Homo sapiens
  misc_feature: HIJSMM301AZN87.52.73.G07.1.454.light.4.raw
cgcagtacgacacgaccggtgctcgatttagctctacgctcagggcacgaccggtgctcgatttagtacacacacttagggattgggggcagaagtctctctcagccaggacacagcatggacatgagggtccctgctcagctcctgggactcctgctgctctggctcccagataccagatgtgacatccagatgacccagtctccatcctccctgtctgcatctgttggagacagagtcaccatctcttgccgggcgagtcaggtcattaacagttatttagcctggtatcagcaaaaaccagggcaagttcctgaactcctgatctatgacacatccactttgcaatcaggggtcccatctcggttcgttggcagtgggtctgggacagattttactctcaccatcagcagcctgcagcctgaagatgttgcaacttatttctgtcataactatgatgatgcccct

SEQ ID NO: 560178 - DNA, 497 bp, Homo sapiens
  misc_feature: HIJSMM301AN25X.12.87.H10.1.454.light.4.raw
atacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcattgggggaaaagtttgctttctggtatcagcagaagccaggccagtcccctgtcttggtcatctataaggatagcaggcggccctcagggattcctgagcgattctccggctccaactccggcaacacagccactctgaccatcagcgggacccaggctctcgatgaggctgactattactgccaggcgtgggacagctccacttcccgtatgtcttcggaggtgggaccatggtcaccgtcctaggtcagcccaagacccaaccccactgt

SEQ ID NO: 560179 - DNA, 497 bp, Homo sapiens; identical to SEQ ID NO: 536807
  misc_feature: HIJSMM301DNLM6.10.37.D04.1.454.light.4.raw

SEQ ID NO: 560180 - DNA, 490 bp, Homo sapiens; identical to SEQ ID NO: 535064
  misc_feature: HIJSMM301EHHON.10.72.G06.1.454.light.4.raw

SEQ ID NO: 560181 - DNA, 483 bp, Homo sapiens
  misc_feature: HIJSMM301D5VWH.41.35.D02.1.454.light.4.raw
tctatactatcacgaccggtgctcgatttagcacacgatagttgggtttgggggagtcagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaccagggaaagcccctaaattcctgatctatcaggcatctaatttggaaagtggggtcccatcaaggtttagcggcagtggatctgggacagaattcactctcacgatcagcggcctgcagcctgatgatgtcgcaacttattactgccaacactatgatagttacccgctcactttcggcggagggaccaaggtggaggtcaagcgaactgtggctggcacc

SEQ ID NO: 560182 - DNA, 487 bp, Homo sapiens
  misc_feature: HIJSMM301EVV4D.5.39.D06.1.454.light.4.raw
atcagacacgcacgaccggtgctcgatttagtgacatctcgcagttctttgggggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccaggagaggccccaaagctccttatttatgatgcctccactttgattagtggggtcccaccaacgttcagcgacagtggatctgggacagagttcactctcaccatcagcagcctgcagcctgatgatcttggaacttattactgccaacaatataaatagttaattggacgttcggccaggggaccaaggtcgaaaatagagacgaaactgtggctgcaccat

SEQ ID NO: 560183 - DNA, 447 bp, Homo sapiens; identical to SEQ ID NO: 535201
  misc_feature: HIJSMM301CD7GA.18.9.A09.1.454.light.4.raw

SEQ ID NO: 560184 - DNA, 493 bp, Homo sapiens; identical to SEQ ID NO: 535657
  misc_feature: HIJSMM301AJ19J.27.78.H01.1.454.light.4.raw

SEQ ID NO: 560185 - DNA, 518 bp, Homo sapiens
  misc_feature: HIJSMM301DT8YG.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattcttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgtcccacct

SEQ ID NO: 560186 - DNA, 492 bp, Homo sapiens; identical to SEQ ID NO: 551166
  misc_feature: HIJSMM301BONR6.47.55.E11.1.454.light.4.raw

SEQ ID NO: 560187 - DNA, 483 bp, Homo sapiens; identical to SEQ ID NO: 542674
  misc_feature: HIJSMM301E03X5.21.25.C03.1.454.light.4.raw

SEQ ID NO: 560188 - DNA, 515 bp, Homo sapiens
  misc_feature: HIJSMM301CIQYB.43.23.C01.1.454.light.4.raw
tgtgagtagtcacgaccggtgctcgatttagtacacgtgattagggattggggtctggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcgggggcaaagctgccctgacactgtcaggtgtgcagcctgaggacgaggctgactattactgcctgctcatatatggtggcgcggtgggtgttcggcggagggaccaagctgaccgtcctgggtcagcccaaggctcgccccctcggtcactctgttcccgctt

SEQ ID NO: 560189 - DNA, 486 bp, Homo sapiens
  misc_feature: HIJSMM301DCKDL.13.5.A05.1.454.light.4.raw
tcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtggagatacaaacgaa

SEQ ID NO: 560190 - DNA, 479 bp, Homo sapiens
  misc_feature: HIJSMM301CS9VX.5.12.B01.1.454.light.4.raw
atcagacacgcacgaccggtgctcgatttagtagtgtagattccgcgggggcccactgttagggctcaggggctgtgtccaccatggcctggactcttctccttctcgtgctcctctctcactgcacaggttccctctcccagcctgtgctgactcagccatcttcccattctgcatcttctggagcatcagtcagactcacctgcatgctgagcagtggcttcagtgttggggacttctggataaggatatcagaggctgattgcagagtcaccttatagatcacttcatagacacagggaacagaagacacagacaactgaggaagcaaagtttaaattctactcacgtttgatttccaccttggtcccttggccgaacgtcctcgggtgttcggcggagggaccaagctgaccgtcctaggtcagcccaaggctgccccctcggtcactctgttcccaccctcctccgtgtctgat

SEQ ID NO: 560191 - DNA, 484 bp, Homo sapiens; identical to SEQ ID NO: 535400
  misc_feature: HIJSMM301AHY5W.46.26.C04.1.454.light.4.raw

SEQ ID NO: 560192 - DNA, 485 bp, Homo sapiens; identical to SEQ ID NO: 544818
  misc_feature: HIJSMM301BUSQT.13.36.D03.1.454.light.4.raw

SEQ ID NO: 560193 - DNA, 494 bp, Homo sapiens; identical to SEQ ID NO: 535629
  misc_feature: HIJSMM301A209S.4.27.C05.1.454.light.4.raw

SEQ ID NO: 560194 - DNA, 489 bp, Homo sapiens
  misc_feature: HIJSMM301BSO7A.41.68.G02.1.454.light.4.raw
tctatactatcacgaccggtgctcgatttagtcgatagtgaagggaaagggcacgaccggtgctcgatttagtcgatagtgaagggaaagggggagtcagtcccaaccaggacacagcatggacatgagggtccctgctcagctcctggggctcctgctgctctggctctcaggtgccagatgtgacatccagatgacccagtctccaacctccctgtctgcatctgtaggagacagagtcaccatcacttgccaggccagtcaggacattagcaactatttaaattggtatcagcagaaaccagggaaagcccctaagctcctgatctacgatgcatccaatttggaatcagggtcccatcaaggttcagtggaagtggatctgggacagattttacttcaccatcaccagcctgcagcctgaagatattgcaacatattactgtcaacagtatgataatctcctcccactttcggcggaggactaac

SEQ ID NO: 560195 - DNA, 484 bp, Homo sapiens; identical to SEQ ID NO: 540489
  misc_feature: HIJSMM301CX4WX.7.75.G09.1.454.light.4.raw

SEQ ID NO: 560196 - DNA, 494 bp, Homo sapiens; identical to SEQ ID NO: 541400
  misc_feature: HIJSMM301A9RUH.51.71.G05.1.454.light.4.raw

SEQ ID NO: 560197 - DNA, 480 bp, Homo sapiens
  misc_feature: HIJSMM301BTPBS.13.8.A08.1.454.light.4.raw
tcacgtactacacgaccggtgctcgatttagcatactctacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggcaagtcagaccattgacaaatatgtaaattggtatcaacagaagccaggtgaagcccctaagctcctgatctatactgcatccactttgtcaggcggggtcccatcaaggttccgtggcagtggatctgggacagatttcactctcaccatcaccagtctgcaacctgaagactgtgcaacttactactgccaacagtcttacggaacctcgtacacttttggccagggaccaggctggagatcaaacgaactgtggctgcaccatctgt

SEQ ID NO: 560198 - DNA, 501 bp, Homo sapiens
  misc_feature: HIJSMM301DYEZU.53.35.D02.1.454.light.4.raw
cgcgtatacacacgaccggtgctcgatttagcacacgatagttgggtttgggggctgtgggctcaggaggcagagctctgggaatctcaccatggcctggacccctctcctgttccccctcctcactttctgcacagtctctgaggcctcctatgagctgacacagccaccctcggtgtcagtgtccccaggacaaacggccaggatcacctgctctggagatgcattgccaagaaatatgcttattggtaccagcagaggtcaggccaggcccctgcgctggtcatctatgaggacaccaaacgaccctccgggatccctgcgagattctctggcgccagctcagggacagtggccaccctgacagtcagtgggcccaggtggaggatgaagctgattactactgttactcaacagacaggagtggaaatcatagggtattcggcggaggggaccaaactgaccgtcctaggtcagcccaaggctgccccctcggtcact

SEQ ID NO: 560199 - DNA, 495 bp, Homo sapiens
  misc_feature: HIJSMM301DPEX4.40.57.F02.1.454.light.4.raw
tctagcgactcacgaccggtgctcgatttagctcgatatagttgggtttgggggctggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttattttgctgctcttatgcaggcagtttcgctctcgaagtgttcggcggagggaccgagctgaccgtcctacggtcagcccaa

SEQ ID NO: 560200 - DNA, 502 bp, Homo sapiens; identical to SEQ ID NO: 541501
  misc_feature: HIJSMM301BD8KD.17.27.C05.1.454.light.4.raw

SEQ ID NO: 560201 - DNA, 489 bp, Homo sapiens
  misc_feature: HIJSMM301AECPM.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattctccagcgttggccaggggaccgaaggtggaagtcaagcgaactgtggctgcaccatctgtt

SEQ ID NO: 560202 - DNA, 534 bp, Homo sapiens
  misc_feature: HIJSMM301CM2PV.52.30.C08.1.454.light.4.raw
cgcagtacgacacgaccggtgctcgatttagtctgacgtcaaagggaaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccggaaatgacattggtggttataattatgtctcctggtaccaacaccacccaggcaaagcccccaaactcattatttatggtgtcggtgaccggccctcaggggtttcgaatcacttctctggctccaagtccggcaacacggcctccctgaccatctctgggctccaggccgaggacgaggctgattattactgcgcctcatatacaaacaacaacaattgggtgttcggcggagggaccaagctgaccgtcctaggtcagcccaaggctgccccctcggtcactctgttcccgccctcctctatacg

SEQ ID NO: 560203 - DNA, 492 bp, Homo sapiens
  misc_feature: HIJSMM301A2B9Z.43.36.D03.1.454.light.4.raw
tgtgagtagtcacgaccggtgctcgatttagctgcgtcacgatctctcttgggggagctacaacaggcaggcaggggcagcaagatggtgttgcagacccaggtcttcatttctctgttgctctggatctctggtgccttcggggacatcgtgatgacccagtctccaggttccctggctgtctctctgggcgagagggccacgctcaagtgcacctccagcgagagtgtgttgtactccccccacccatcagcacgccttagcctggtaccagcacaagtcagggcagcctcctaagttgctcttttactggacttcgatccgcgcatctggggtccctgaccgattcatgggcagcggctctgggacagacttcgctctcaccatcaacagcctccaggctgaggatgcggcggtttatattgtcaacaatattttagtgctccgtacacttttggccaggggaccaagttggagatcaaacgactgtgg

SEQ ID NO: 560204 - DNA, 499 bp, Homo sapiens
  misc_feature: HIJSMM301CCQOL.21.81.H04.1.454.light.4.raw
tcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacgaggctgattattactgcaggtcatatacaatcagcaacacttatgtcttcgggactgggaccaagatcaccgtcctaggtcagccaaggccaacccactgtca

SEQ ID NO: 560205 - DNA, 505 bp, Homo sapiens
  misc_feature: HIJSMM301C6UIG.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccaaggaccgaaggtaggaaagtacaaacgaactagtggctgcaccact

SEQ ID NO: 560206 - DNA, 501 bp, Homo sapiens
  misc_feature: HIJSMM301BTTDS.10.9.A09.1.454.light.4.raw
catagtagtgcacgaccggtgctcgatttagcgagacgcgcagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctgggaccaaagtggagatcaaacgaactgtggctgcaccatctgtcttcta

SEQ ID NO: 560207 - DNA, 447 bp, Homo sapiens; identical to SEQ ID NO: 535020
  misc_feature: HIJSMM301A32SA.18.9.A09.1.454.light.4.raw

SEQ ID NO: 560208 - DNA, 521 bp, Homo sapiens; identical to SEQ ID NO: 539470
  misc_feature: HIJSMM301A9PXA.27.23.C01.1.454.light.4.raw

SEQ ID NO: 560209 - DNA, 493 bp, Homo sapiens; identical to SEQ ID NO: 540127
  misc_feature: HIJSMM301AYQVN.10.17.B06.1.454.light.4.raw

SEQ ID NO: 560210 - DNA, 495 bp, Homo sapiens; identical to SEQ ID NO: 557386
  misc_feature: HIJSMM301DDLCA.27.78.H01.1.454.light.4.raw

SEQ ID NO: 560211 - DNA, 416 bp, Homo sapiens; identical to SEQ ID NO: 536892
  misc_feature: HIJSMM301A1JH7.16.46.E02.1.454.light.4.raw

SEQ ID NO: 560212 - DNA, 420 bp, Homo sapiens
  misc_feature: HIJSMM301DIWUX.9.34.D01.1.454.light.4.raw
tgatacgtctcacgaccggtgctcgatttagatcgtctgtgttgggtttggggctgttcctggaagttgttggtaccagagggtcaccatctcgtgcactggaagtagctccaacatcggggcacgttatgatgtacactggtaccaacaacttccaggaacagcccccaaagtcatcatttatgacaacatgaagcggccctcaggggtccctgaccgattctccggctccaagtctggcacatcagcctccctgaccatcactgggctccaggctgaggatgaggctgactattactgccagtcgtatgacagtggcctaagtaacatcgtcttcggaactgggaccaaggtcaccgtcctgggtcagcccaaggccaacccactgtcactctgttcccaccctcctcagacgtatca

SEQ ID NO: 560213 - DNA, 518 bp, Homo sapiens
  misc_feature: HIJSMM301AS5TS.10.59.F04.1.454.light.4.raw
catagtagtgcacgaccggtgctcgatttagtacacacacttagggattggggggggtctcaggaggcagcactctcgggacgtctccaccatggcctgggctctgctattcctcaccctcctcactcagggcacaggttcctgggcccagtctgccctgtctcagcctgcctccgtgtctgggtctcctggacagtcgatcaccatctcctgcaatggaagcgaaagtgacattggttctttaaattttgtctcttggtaccaacagagcccagacaaagcccccaaaattatcatttctgctgtcagtaatcggccctcaggggtttctagtcgcttctctggctccaagtctggcaacacggcctccctgaccatctctgggctccaggctgaggacgaggctgattattattgcagctcatatacaaacaccaaagctttgatattcggcggagggaccaaactgaccgtccttcgtcagcccaaggctgccccctcggtcactctgttccccg

SEQ ID NO: 560214 - DNA, 499 bp, Homo sapiens
  misc_feature: HIJSMM301B17BL.21.27.C05.1.454.light.4.raw
  modified_base (198)..(198): a, c, t, g, unknown or other
tcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttagcctggtaccagcagaaatctggccaggctcccaggctcctcatttaccgtgcatccaccagggccactggtgtcccagacaggttcagtggcggtggatttgggacagagttttctctcaccatcagcgccctacagagtgaagatgttgcagtttatttctgccagcaatataattactggcctgcgtcgacgttcggccaccgggaccaacggtggaaatacaaacgaactagtggctgcaccatctgtctt

SEQ ID NO: 560215 - DNA, 444 bp, Homo sapiens; identical to SEQ ID NO: 549841
  misc_feature: HIJSMM301BW6LA.14.76.G10.1.454.light.4.raw

SEQ ID NO: 560216 - DNA, 444 bp, Homo sapiens; identical to SEQ ID NO: 535411
  misc_feature: HIJSMM301D8WR0.8.73.G07.1.454.light.4.raw

SEQ ID NO: 560217 - DNA, 504 bp, Homo sapiens
  misc_feature: HIJSMM301DECDO.48.12.B01.1.454.light.4.raw
agtatacatacacgaccggtgctcgatttagtagtgtagattccgcggggatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaagtaaaaatggaaacatttacttacattggtttcaacagaggccaggccagtctccaaggcgcctgatttatgacgtttttaaacgggagtctggggtcccagacagattcagcggcagtgggtcagacactgacttcacactgagaatcagcagggttgaggctgaggatgttggcacttattactgcatgcaaggctcacactggcctccgtggacgttcggccaagggacccggtggaaataaacgaactgtggctgcaccatctgtcttca

SEQ ID NO: 560218 - DNA, 490 bp, Homo sapiens; identical to SEQ ID NO: 535420
  misc_feature: HIJSMM301CTF2H.3.72.G06.1.454.light.4.raw

SEQ ID NO: 560219 - DNA, 490 bp, Homo sapiens
  misc_feature: HIJSMM301B7TZ6.51.67.G01.1.454.light.4.raw
cgatcgtatacacgaccggtgctcgatttagagtatacatattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggatccctgagcgattctctggctccaactctgggaacacagccactctgaccatcagcgggacgcaggctgtggatgaggctgacttttactgtcaggcgtgggacagcgacactgccgtgttcggcgggggaccaagctgaccgtcctcggtcagcccaaggctgccccctcggt

SEQ ID NO: 560220 - DNA, 497 bp, Homo sapiens
  misc_feature: HIJSMM301EEHED.10.79.H02.1.454.light.4.raw
catagtagtgcacgaccggtgctcgatttagtgtcacacgaagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccgaggggaaagagccacgctctcctgcagggccagtcagagtcttagcagcaactacgttgcctggtaccaacagaaacctggccaggcctcccgggctcctcatctatggtacatctagcagggccactggcatcccagacaggttcagtggcagtgggtctgggacagacttcactctcaccatcagcagactggagtctgaagatttgcagtgtattattgtcagcaatatggtaggtcacctgggtacttttggccaggggaccaagcgtggagatacaaacgaactgtggctgcaccatctgtctt

SEQ ID NO: 560221 - DNA, 509 bp, Homo sapiens; identical to SEQ ID NO: 541168
  misc_feature: HIJSMM301APW0Z.5.60.F05.1.454.light.4.raw

SEQ ID NO: 560222 - DNA, 494 bp, Homo sapiens; identical to SEQ ID NO: 535276
  misc_feature: HIJSMM301EOXHG.16.6.A06.1.454.light.4.raw

SEQ ID NO: 560223 - DNA, 497 bp, Homo sapiens
  misc_feature: HIJSMM301CKY1T.52.38.D05.1.454.light.4.raw
cgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactcgtcact

SEQ ID NO: 560224 - DNA, 479 bp, Homo sapiens
  misc_feature: HIJSMM301DV9LX.13.6.A06.1.454.light.4.raw
tcacgtactacacgaccggtgctcgatttagatctactgacagggcagactgagcccaggatcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacaacacccaggcaaagcccccaaaatcatgatttatgatgtcagtaagcggccctcaggggtccctgatcgcttctctgcctccaagtctggcaacacggcctccctgaccatctctgggctccaggctgaggatgagtctgattattactgctgctcatatgcaggcagctacactgtactattcggcggagggaccaagctgaccgtcctaggtcagcccaaggctgccccctcggtcactctcg

SEQ ID NO: 560225 - DNA, 504 bp, Homo sapiens
  misc_feature: HIJSMM301A0OSG.49.82.H05.1.454.light.4.raw
agtcgagagacacgaccggtgctcgatttagtcgagctctctcgcggggggggtcacaagaggcagcgctctcgggacgtctccaccatggcctgggctctgctgctcctcactctcctcactcaggacacagggtccgtgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaactcatcatttatgaggccgatcagcggccctcaggggtctctgatcgcttctctggctccacgtctggcagcacggcctccctgacaatctctgggctccaggctggggacgaggctgattattattgctgttcatatgccggtgatagtggccgaagggtgttcggcggagggaccaaggtgaccgtcctaggtcagcccaaggctgccccctcggt

SEQ ID NO: 560226 - DNA, 487 bp, Homo sapiens
  misc_feature: HIJSMM301DXC2Q.21.65.F10.1.454.light.4.raw
tcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaaacctggccagcctcccaggctcctcatctatggtgcatccgccagggccactggaatcccagccaggttcagtggcactgggtctgggacagagttcactctcaccatcagcagcctgcagtctgaagattttgaagtttatttctgtctgcagtacaatcagtggcctcggacgttcggccaagggaccaaggtggaaatcaaacgaactgtggctgcaccatctgtcttc

SEQ ID NO: 560227 - DNA, 501 bp, Homo sapiens; identical to SEQ ID NO: 544332
  misc_feature: HIJSMM301DHUFN.22.57.F02.1.454.light.4.raw

SEQ ID NO: 560228 - DNA, 486 bp, Homo sapiens; identical to SEQ ID NO: 535043
  misc_feature: HIJSMM301ALWA4.46.35.D02.1.454.light.4.raw

SEQ ID NO: 560229 - DNA, 495 bp, Homo sapiens; identical to SEQ ID NO: 535821
  misc_feature: HIJSMM301DGYIZ.3.31.C09.1.454.light.4.raw

SEQ ID NO: 560230 - DNA, 447 bp, Homo sapiens; identical to SEQ ID NO: 535020
  misc_feature: HIJSMM301EV0HF.18.9.A09.1.454.light.4.raw

SEQ ID NO: 560231 - DNA, 505 bp, Homo sapiens
  misc_feature: HIJSMM301EGVT5.5.86.H09.1.454.light.4.raw
atcagacacgcacgaccggtgctcgatttagtgctatagacttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgtactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaagctgaccgtcctaggtcagcccaaggctgccccctcggtcact

SEQ ID NO: 560232 - DNA, 473 bp, Homo sapiens
  misc_feature: HIJSMM301A9FPK.15.81.H04.1.454.light.4.raw
tctacgtagccacgaccggtgctcgatttagtagtgtagattcgcgggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgcatctcatatacaaccaacagcactctcgactggtattcggcggagggaccaagctgaccgtcctaggtcagcccaaggctgccacctcggtcactctgttcccaccctcctcgctacgtaga

SEQ ID NO: 560233 - DNA, 486 bp, Homo sapiens; identical to SEQ ID NO: 552083
  misc_feature: HIJSMM301AS7H5.47.70.G04.1.454.light.4.raw

SEQ ID NO: 560234 - DNA, 505 bp, Homo sapiens
  misc_feature: HIJSMM301CYHNH.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcgggcgttcggccaagggaccgaaggtggaaatcaaacgaactgtggctgcaccatctgtcttcactcttccccg

SEQ ID NO: 560235 - DNA, 505 bp, Homo sapiens; identical to SEQ ID NO: 535503
  misc_feature: HIJSMM301ENSEH.8.28.C06.1.454.light.4.raw

SEQ ID NO: 560236 - DNA, 514 bp, Homo sapiens
  misc_feature: HIJSMM301BF19O.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctggtccactctgttcccgccctcctcgctacgtaga

SEQ ID NO: 560237 - DNA, 509 bp, Homo sapiens
  misc_feature: HIJSMM301CE2D2.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataatttctgggtgttcggcggagggaccaaactgaccgtcctaggtcagccaaggctgccccctcggtcactctgttccccg

SEQ ID NO: 560238 - DNA, 487 bp, Homo sapiens; identical to SEQ ID NO: 537573
  misc_feature: HIJSMM301B5ESC.3.10.A10.1.454.light.4.raw

SEQ ID NO: 560239 - DNA, 507 bp, Homo sapiens; identical to SEQ ID NO: 539817
  misc_feature: HIJSMM301DJGKV.5.24.C02.1.454.light.4.raw

SEQ ID NO: 560240 - DNA, 488 bp, Homo sapiens; identical to SEQ ID NO: 545567
  misc_feature: HIJSMM301E11I6.47.38.D05.1.454.light.4.raw

SEQ ID NO: 560241 - DNA, 505 bp, Homo sapiens
  misc_feature: HIJSMM301CBMN2.8.28.C06.1.454.light.4.raw
ctcgcgtgtccacgaccggtgctcgatttagagctcacgtattgggtttgggggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgtttactttcggtcggagggaccaaggtggacctcaaacgaactgtggctgcaccatctgtcttcatcttcccgccat

SEQ ID NO: 560242 - DNA, 488 bp, Homo sapiens; identical to SEQ ID NO: 535081
  misc_feature: HIJSMM301B6CK1.26.23.C01.1.454.light.4.raw

SEQ ID NO: 560243 - DNA, 487 bp, Homo sapiens; identical to SEQ ID NO: 536536
  misc_feature: HIJSMM301D8V52.26.45.E01.1.454.light.4.raw

SEQ ID NO: 560244 - DNA, 462 bp, Homo sapiens
  misc_feature: HIJSMM301D2BYN.4.29.C07.1.454.light.4.raw
agcactgtagcacgaccggtgctcgatttagagtgctacgaagggaaagggggaagagctgctcagttaggacccagagggaaccatggaaaccccagcgcagcttctcttcctcctgctactctggctccctggggaaagagccaccctctcctgcagggccagtcagaatgttagcagcagattcttagcctggtatcagcagagacgtggccaggctcccaggctcatcatctatggtgcatccagcagggccactggcatcccagacaggttcagtggcagtgggtctgggacagacttcactctcaccatcagcgacctggagcctgaagattttgcagtgtattactgtcagcagtatggtagcgcacggacgttcggccaaggggccagggtggaaatcaaacgaactgtggctgcacatctgtcttcatcttcccgccatctgactacagtgct

SEQ ID NO: 560245 - DNA, 482 bp, Homo sapiens
  misc_feature: HIJSMM301D6FYH.8.12.B01.1.454.light.4.raw
ctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccatgtccccaggacagacagccaggatcacctgctctggagataaattgggggataaatatgcttgctggtatcagcagaggccaggccagtcccctgtactggtcatctatcaagataacaagcggccctcagggatccctgagcgattctctggctccaactctgggaacacagccactctgaccatcagcgggacccaggctacggatgaggctgactattactgtcaggcgtgggacagcagcacctatgtggttttcggcggagggaccaagctgaccgtccttggtcagcccaaggctcg

SEQ ID NO: 560246 - DNA, 489 bp, Homo sapiens
  misc_feature: HIJSMM301DLMKP.13.87.H10.1.454.light.4.raw
tcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagcaaaaaccagggaaagtccctaagctcctgatctatgttgcatccactttgcaaagtggggtcccatcaaggttcagcggcagtggatctgggacagaattcactctcacaatcagcagcctgcagcctgaagattttgcaacttattactgtcaacagcttaatagttacccgctcagtttcggcggagggaccaaggtggagatacaaacgaactgtggctgcaccatctgtt

SEQ ID NO: 560247 - DNA, 492 bp, Homo sapiens; identical to SEQ ID NO: 538317
  misc_feature: HIJSMM301BO6JT.10.17.B06.1.454.light.4.raw

SEQ ID NO: 560248 - DNA, 520 bp, Homo sapiens; identical to SEQ ID NO: 535773
  misc_feature: HIJSMM301AX4CJ.41.19.B08.1.454.light.4.raw

SEQ ID NO: 560249 - DNA, 485 bp, Homo sapiens; identical to SEQ ID NO: 535653
  misc_feature: HIJSMM301BHYUI.47.62.F07.1.454.light.4.raw

SEQ ID NO: 560250 - DNA, 493 bp, Homo sapiens
  misc_feature: HIJSMM301AULIX.49.52.E08.1.454.light.4.raw
agtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgt

SEQ ID NO: 560251 - DNA, 488 bp, Homo sapiens; identical to SEQ ID NO: 540342
  misc_feature: HIJSMM301B97SS.43.33.C11.1.454.light.4.raw

SEQ ID NO: 560252 - DNA, 521 bp, Homo sapiens; identical to SEQ ID NO: 538715
  misc_feature: HIJSMM301BF5LQ.27.23.C01.1.454.light.4.raw

SEQ ID NO: 560253 - DNA, 498 bp, Homo sapiens
  misc_feature: HIJSMM301AYD4Y.48.14.B03.1.454.light.4.raw
agtatacatacacgaccggtgctcgatttagtgtgagtagttccgcgggcacgaccggtgctcgatttagtgtgagtagtttgggtttggggaagagctgctcagttaggacccagagggaaccatggaaaccccagcgcagcttctcttcctcctgctactctggctcccagataccaccggagcacttgtgttgacgcagtctccaggcaccctgtctttgtctccaggggagagagccaccctctcctgcagggccagtcagagtgttagcggcggctccgtagcctggtaccagcagaaacgtggccaggttcccaggctcctcatctatgatgcatccagcagggccactggcatcccagacaggttcagtggcagtgggtctgggacagacttcactctcaccatcagcagactggagcctgaagattttgcagtgtattactgtcagcagtatggtagctcacctcaactcactttcggcggagggaaccg

SEQ ID NO: 560254 - DNA, 421 bp, Homo sapiens
  misc_feature: HIJSMM301EWEE0.16.46.E02.1.454.light.4.raw
tgtactactccacgaccggtgctcgatttagactcatctacagggaaagggggctgtgcctggggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccgggctgaggacgaggctgattattactgcagcttatatacaaccaacagcactctcgactggtattcggcggagggaccaagctgaccgtcctaggtcagcccaaggctgccccctcggtcactctgttcccgccctcctcgagtagtaca

SEQ ID NO: 560255 - DNA, 454 bp, Homo sapiens; identical to SEQ ID NO: 534964
  misc_feature: HIJSMM301AMKT5.19.86.H09.1.454.light.4.raw

SEQ ID NO: 560256 - DNA, 415 bp, Homo sapiens
  misc_feature: HIJSMM301ER5BW.10.86.H09.1.454.light.4.raw
catagtagtgcacgaccggtgctcgatttagtgctatagacttgggtttgggttgagaacctatgaacattctgtaggggtcaccgtctcctgctctggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccagaccggggacgaggccgattattactgcgcaacttgggactccaacctgactgttggggctttcggcggagggactaagttgaccgtcctacgtcagcccaaggctgccccctcggtcactctgttcccaccctcctccactactatg

SEQ ID NO: 560257 - DNA, 490 bp, Homo sapiens
  misc_feature: HIJSMM301D3FOP.19.57.F02.1.454.light.4.raw
tactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgcaacttatttttgtcaacaggctaacactttcccctcactttcggcggagggaccaaggtggagatcaagcgaactgtggctgcaccatctgtctt

SEQ ID NO: 560258 - DNA, 476 bp, Homo sapiens; identical to SEQ ID NO: 536632
  misc_feature: HIJSMM301C8GNH.52.1.A01.1.454.light.4.raw

SEQ ID NO: 560259 - DNA, 490 bp, Homo sapiens; identical to SEQ ID NO: 538273
  misc_feature: HIJSMM301BYZEB.16.73.G07.1.454.light.4.raw

SEQ ID NO: 560260 - DNA, 483 bp, Homo sapiens
  misc_feature: HIJSMM301BE5D5.49.28.C06.1.454.light.4.raw
agtcgagagacacgaccggtgctcgatttagagctcacgtattgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataattactggctcgtttttggccaggggaccaagctggagatcaagcgaactgtggctgcaccat

SEQ ID NO: 560261 - DNA, 496 bp, Homo sapiens
  misc_feature: HIJSMM301B3KKL.16.46.E02.1.454.light.4.raw
tgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaacccactgtcactctgttcccgccctcctcgagtagtaca

SEQ ID NO: 560262 - DNA, 484 bp, Homo sapiens; identical to SEQ ID NO: 535400
  misc_feature: HIJSMM301A9X03.46.26.C04.1.454.light.4.raw

SEQ ID NO: 560263 - DNA, 504 bp, Homo sapiens; identical to SEQ ID NO: 537659
  misc_feature: HIJSMM301DXW8D.13.55.E11.1.454.light.4.raw

SEQ ID NO: 560264 - DNA, 520 bp, Homo sapiens; identical to SEQ ID NO: 539176
  misc_feature: HIJSMM301A7YM5.27.23.C01.1.454.light.4.raw

SEQ ID NO: 560265 - DNA, 490 bp, Homo sapiens
  misc_feature: HIJSMM301B6CH7.3.33.C11.1.454.light.4.raw
agacgcactccacgaccggtgctcgatttagagtgagctcgttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggct

SEQ ID NO: 560266 - DNA, 501 bp, Homo sapiens; identical to SEQ ID NO: 550139
  misc_feature: HIJSMM301AVYX6.15.56.F01.1.454.light.4.raw

SEQ ID NO: 560267 - DNA, 492 bp, Homo sapiens
  misc_feature: HIJSMM301A8UH1.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgcagtctgaagattttgcagtttattactgtcagcagtatgatacctggcctccgtacacttttgccgggggaccaagctggaaatcaagcgaactgtggctgcaccatctgtcttcatt

SEQ ID NO: 560268 - DNA, 513 bp, Homo sapiens
  misc_feature: HIJSMM301BYZMM.52.46.E02.1.454.light.4.raw
cgcagtacgacacgaccggtgctcgatttagactcatctacagggaaaggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttataattctgtctcctggtaccaacaataccccggcaaagtccccaaactcatgatctttgaggtcaatgatcggcccgcaggggtttctcatcgcttctccggctccaagtctggcagcacggcctccctgaccatctctgggctccaggctgaggacgaggctgattattactgcagctcatatacaaacagaaacacttgggtgttcggcggcgggaccagactgaccgtcctacgtcagcccaaggctgccccctcggtcactcttcg

SEQ ID NO: 560269 - DNA, 511 bp, Homo sapiens
  misc_feature: HIJSMM301DPJNN.48.16.B05.1.454.light.4.raw
agtatacatacacgaccggtgctcgatttagagctcacgtaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctagacaatcgattaccatctcctgcactggaaccagcagtgatattgggagtcataaccttgtctcctggtatcaacaatatccaggcagagccccccaactcataatttatgcggcctctcagcggcccccaggggtttccagtcgcttctctgcctccaagtctggcaacacggcctccttgacaatctctggcctccagcctgaggacgaggctgactattactgctgctcatatacaactatgaatgctttttgtttcggcggagggaccgaaactgaccgtccctcggtcggcccgaaggctgccccctccggtccgactctccg

SEQ ID NO: 560270 - DNA, 503 bp, Homo sapiens; identical to SEQ ID NO: 538884
  misc_feature: HIJSMM301EUK3R.27.78.H01.1.454.light.4.raw

SEQ ID NO: 560271 - DNA, 489 bp, Homo sapiens; identical to SEQ ID NO: 535091
  misc_feature: HIJSMM301BLNSW.47.36.D03.1.454.light.4.raw

SEQ ID NO: 560272 - DNA, 493 bp, Homo sapiens; identical to SEQ ID NO: 536769
  misc_feature: HIJSMM301AGHEA.19.83.H06.1.454.light.4.raw

SEQ ID NO: 560273 - DNA, 494 bp, Homo sapiens; identical to SEQ ID NO: 534994
  misc_feature: HIJSMM301A2DXS.27.78.H01.1.454.light.4.raw

SEQ ID NO: 560274 - DNA, 489 bp, Homo sapiens; identical to SEQ ID NO: 553147
  misc_feature: HIJSMM301A9YMO.12.23.C01.1.454.light.4.raw

SEQ ID NO: 560275 - DNA, 506 bp, Homo sapiens
  misc_feature: HIJSMM301DYEPT.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcgccgaaggaccgaaggtaggaaatacaaacgaactagtggcgtgcaccatctgtcttcatcttccccg

SEQ ID NO: 560276 - DNA, 514 bp, Homo sapiens
  misc_feature: HIJSMM301C41IO.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctggtcactctgttcccaccctcctcgctacgtagac

SEQ ID NO: 560277 - DNA, 515 bp, Homo sapiens
  misc_feature: HIJSMM301BM68I.51.19.B08.1.454.light.4.raw
cgatcgtatacacgaccggtgctcgatttagtgagtcagtaaggggtgggcctaaggaagcagcactggtggtgcctcagccatggcctggaccgttctcctcctcggcctcctctctcactgcacagtctctgtgacatcctatgtgctgactcagccaccctcggtgtcagtggccccaggacagacggccaggatttcctgtgggggagacaacattggaagtaaaagtgtacactggtaccagcagaggccaggccaggcccctgtgttggtcgtctatgattataacgaccggccctcagggatccctgaccgattctctggctccatctctgggaacacggccactctgaccatcagcagggtcgaagccggggatgaggccgactattactgtcaggtgtgggaaagtagtagtgatcattatgtcttcggaagtgggaccaaggtcaccgtcctaggtcagcccaaggccaaccccactgtcactctgttcccacctcctctcgtag

SEQ ID NO: 560278 - DNA, 468 bp, Homo sapiens; identical to SEQ ID NO: 551278
  misc_feature: HIJSMM301D4YPV.48.39.D06.1.454.light.4.raw

SEQ ID NO: 560279 - DNA, 485 bp, Homo sapiens; identical to SEQ ID NO: 538954
  misc_feature: HIJSMM301CS82K.3.55.E11.1.454.light.4.raw

SEQ ID NO: 560280 - DNA, 520 bp, Homo sapiens; identical to SEQ ID NO: 539176
  misc_feature: HIJSMM301BIMQS.27.23.C01.1.454.light.4.raw

SEQ ID NO: 560281 - DNA, 521 bp, Homo sapiens
  misc_feature: HIJSMM301AJYLO.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcattctgttcccgccct

SEQ ID NO: 560282 - DNA, 447 bp, Homo sapiens
  misc_feature: HIJSMM301AL8V8.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccaggaacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccaccctcctccatactcgta

SEQ ID NO: 560283 - DNA, 495 bp, Homo sapiens; identical to SEQ ID NO: 547774
  misc_feature: HIJSMM301B1TI0.16.78.H01.1.454.light.4.raw

SEQ ID NO: 560284 - DNA, 484 bp, Homo sapiens
  misc_feature: HIJSMM301BCCV7.5.39.D06.1.454.light.4.raw
atcagacacgcacgaccggtgctcgatttagtgacatctcgcagttctttgggggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccaggagaggccccaaagctccttatttatgatgcctccactttgattagtggggtcccaccaacgttcagcggcagtggatctgggacagagttcactctcaccatcagcagcctgcagcctgatgatcttggaacttattactgccaacaatataatagttattggacgttcggtccaggggaccaaggtcgaaatagagacgaactgtggctgcaccat

SEQ ID NO: 560285 - DNA, 510 bp, Homo sapiens
  misc_feature: HIJSMM301CHTT6.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggcccccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcacttcgtcggagggaccgacgggtaggaggatcaaacgaaactagtggcgtgcgaccactcttgtcttctatcttccccg

SEQ ID NO: 560286 - DNA, 491 bp, Homo sapiens; identical to SEQ ID NO: 535294
  misc_feature: HIJSMM301DSZSU.16.68.G02.1.454.light.4.raw

SEQ ID NO: 560287 - DNA, 502 bp, Homo sapiens
  misc_feature: HIJSMM301CO1UE.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccaaaatagaggtcaacgaactgtggctgcaccatctgtcttcatt

SEQ ID NO: 560288 - DNA, 488 bp, Homo sapiens; identical to SEQ ID NO: 538017
  misc_feature: HIJSMM301CT6V2.4.59.F04.1.454.light.4.raw

SEQ ID NO: 560289 - DNA, 515 bp, Homo sapiens
  misc_feature: HIJSMM301BQ89O.16.85.H08.1.454.light.4.raw
tgtactactccacgaccggtgctcgatttagtatcactcagtcgcggggctgggcctaaggaagcagcactggtggtgcctcagccatggcctggaccgttctcctcctcggcctcctctctcactgcacaggctctgtgacctcctatgtgctgactcagccaccctcggtgtcgttggccccaggacagacggccttaataacctgtgggggaagcaacattggaagcaaaaatgtgcactggtacatgcagaggccaggccaggcccctgttttggtcgtctatgatgataccgagcggccctcagggatccctgagcgattctccggctccaactctggtgacacggccaccctgaccatcaacagggtcgaagtcggggatgaggccgactattactgtcaggtgtgggatggtgttagtgatcgggcacttttcggcggagggacccagctgaccgtcctaggtcagcccaaggctgccccctcggtcactctgttcccaccctcctcg

SEQ ID NO: 560290 - DNA, 515 bp, Homo sapiens
  misc_feature: HIJSMM301AQ5NN.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcggggcgttcggtccaagggaccgaacggtaggaaagtacaaaacgaacctagtggcgtgcaccactctgtcttcatcttccccg

SEQ ID NO: 560291 - DNA, 462 bp, Homo sapiens
  misc_feature: HIJSMM301BD10R.5.28.C06.1.454.light.4.raw
atcagacacgcacgaccggtgctcgatttagagctcacgtattgggtttgggggcaggagtcagtcccaaccaggacacagcatggacatgagggtccctgctcagctcctggggctcctgctgctctggctctcaggtgccagatgtgacatccagatgacccagtctccatcgtccgtgtctgcatctgtaggagacagagtcaccatcacttgtcaggcgagtcaggacattggtaattacttaacttggtatcagcagaaaccagggaaagtccccaaactcctgatctacgatgcatctaatttggaaataggggtctcatcaaggttcagtgggagtggatctgggacagaattcactttcaccatcagcagcctgcaacctgaagatattgcaacatattactgtcaacagtatgatagtctgccgccttcgcgaggcaaggtggagatgacgaa

SEQ ID NO: 560292 - DNA, 487 bp, Homo sapiens
  misc_feature: HIJSMM301ASKSF.14.53.E09.1.454.light.4.raw
cgtctagtaccacgaccggtgctcgatttagagagagtgtgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgctttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttatcgggtgttcggcggagggaccaagctgaccgtcctaggtcagcccaaggctcgccccctcggtccta

SEQ ID NO: 560293 - DNA, 494 bp, Homo sapiens; identical to SEQ ID NO: 534992
  misc_feature: HIJSMM301BELE7.9.1.A01.1.454.light.4.raw

SEQ ID NO: 560294 - DNA, 485 bp, Homo sapiens; identical to SEQ ID NO: 535880
  misc_feature: HIJSMM301BZ0EL.7.75.G09.1.454.light.4.raw

SEQ ID NO: 560295 - DNA, 507 bp, Homo sapiens
  misc_feature: HIJSMM301C8A0B.21.87.H10.1.454.light.4.raw
tcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacgttttaaccttgtctcctggtatcaacaacaccaggacaaagccccaaaactcttaatttctggcgtcaatcagcgaccctcacatgtttccagtcgattctctgcatccaagtctggcaacacggcctttctgacaatctctcaactccaggctgaagacgaggctatttattactgctctcatacgcaggtggcacatttttcttggtttttggcggcgggacccagatggactgtcctcagtcagcccaaggctgccccctcggt

SEQ ID NO: 560296 - DNA, 511 bp, Homo sapiens
  misc_feature: HIJSMM301A79R6.51.80.H03.1.454.light.4.raw
cgatcgtatacacgaccggtgctcgatttagctgtgcgtcgaagggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctcctggtaccaacaccacccaggcaaagcccccaaactcatgatttatgatgtcagtgatcggccctcaggggtttcgaatcgcttctctggctccaagtccggcaacacggcctccctgaccatctctgggctccaggccgaggacgaggctgattattactgcacctcatatacaagcagcaacaattgggtgttcggcggagggaccaagctgaccgtcctaggtcagcccaaggctgccccctcggtcactctcg

SEQ ID NO: 560297 - DNA, 484 bp, Homo sapiens
  misc_feature: HIJSMM301BYPAB.49.73.G07.1.454.light.4.raw
agtcgagagacacgaccggtgctcgatttagctctacgctcagggcacgaccggtgctcgatttagagctcacgtattgggtttggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataattactggctcgttttggccagggaccaag

SEQ ID NO: 560298 - DNA, 504 bp, Homo sapiens
  misc_feature: HIJSMM301AMCHI.47.83.H06.1.454.light.4.raw
agctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatactcccccagctggtaccagcagaccccgggccagactccacgcacgctcatctacaacacagacactcgctcttctggggtccctgatcgcttctctggttccatccttgggaacaaagctgccctcaccatcgcggggcccaggcagatgatgagtgtgattattactgtgtgctctatatgggcagtggcgtttgggtgttcggcggagggaccaagctgaccgtc

SEQ ID NO: 560299 - DNA, 505 bp, Homo sapiens
  misc_feature: HIJSMM301DQT8R.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggcaaggaccaggtggaagtcaagcgaactgtggctgcaccatctgtcttcatcttcccgcc

SEQ ID NO: 560300 - DNA, 492 bp, Homo sapiens
  misc_feature: HIJSMM301D09JK.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatctgtcttcatcttccc

SEQ ID NO: 560301 - DNA, 500 bp, Homo sapiens
  misc_feature: HIJSMM301A0THC.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagactcaaacgaactgtggctgcaccatctgtcttcatcttcccgcactctgacta

SEQ ID NO: 560302 - DNA, 516 bp, Homo sapiens
  misc_feature: HIJSMM301CQEI3.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggccctgctgctgctgggtctggccatggtcgcccatggcctgctgcgcccaatggttgcaccgcaaagcggggacccagaccctggagcctcagttggaagcagccgatcccagcctgcggagcctgtgggcaggtcagcccaaggccaacccactgtcactctcg

SEQ ID NO: 560303 - DNA, 488 bp, Homo sapiens; identical to SEQ ID NO: 551155
  misc_feature: HIJSMM301D6DIF.3.33.C11.1.454.light.4.raw

SEQ ID NO: 560304 - DNA, 502 bp, Homo sapiens
  misc_feature: HIJSMM301BA0KR.9.27.C05.1.454.light.4.raw
tgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccaggggaaagagccaccctctcctgtcgggccagtcagagtgttagaagcaacttagcctggtaccaacagagacctggccagcctcccaggctcctcatctttgatgcatccactagggccagtggaatcccagacaggttcagtggcagtgggtctgggacagagttcactctcagcatcaacagcgtgcgggctgaagtatttttgtttttattattgtcagcagtatgataactggcctctgtggacgttcggccaagggaccaaggtggatgtacaaacgactgtggctgcaccatctgtcttcattcc

SEQ ID NO: 560305 - DNA, 507 bp, Homo sapiens; identical to SEQ ID NO: 535930
  misc_feature: HIJSMM301ENWOO.15.34.D01.1.454.light.4.raw

SEQ ID NO: 560306 - DNA, 486 bp, Homo sapiens; identical to SEQ ID NO: 535385
  misc_feature: HIJSMM301BX7QD.19.71.G05.1.454.light.4.raw

SEQ ID NO: 560307 - DNA, 484 bp, Homo sapiens; identical to SEQ ID NO: 535400
  misc_feature: HIJSMM301B3YQU.46.26.C04.1.454.light.4.raw

SEQ ID NO: 560308 - DNA, 504 bp, Homo sapiens
  misc_feature: HIJSMM301BYMM2.40.26.C04.1.454.light.4.raw
tctagcgactcacgaccggtgctcgatttagtctagcgactttgggtttgggggagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagtcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttcccg

SEQ ID NO: 560309 - DNA, 480 bp, Homo sapiens
  misc_feature: HIJSMM301DSEC4.12.8.A08.1.454.light.4.raw
atacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccagcatcacctgctctggagatgtattgactaatgagtatgcttcctggtatcagcagaaggcaggccagccccctgtcctactcatctttcaaataccaggctgccctctggggtccctgagcgattctctggctccgactctgggaacacagtcactctgaccatcagcgggacccaggctattgatgaggctgtctactactgtcaggcgtgggacagcagcgtggtgttcggcggagggaccagtctgaccgtcttaggtcagcccaaggctgccccctcggt

SEQ ID NO: 560310 - DNA, 499 bp, Homo sapiens
  misc_feature: HIJSMM301A8WQM.13.39.D06.1.454.light.4.raw
tcacgtactacacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacagcagtgatcttgggacttatagacttgtctcctggtaccaacaccacccaggcaaggcccccagagtcatcatttatgggggcaataggcggccgtcagggatttccactcgcttctctggctccaagtctggcaacacggcctccctgacaatctctggtctccaggctgaggacgaggctgcctattactgctgctcatatgcaggttcttctgtggtcttcggcggagggtccaaagtgaccgtcctaggtcagcccaaggctgccccctc

SEQ ID NO: 560311 - DNA, 447 bp, Homo sapiens; identical to SEQ ID NO: 535201
  misc_feature: HIJSMM301C5ZLX.18.9.A09.1.454.light.4.raw

SEQ ID NO: 560312 - DNA, 493 bp, Homo sapiens; identical to SEQ ID NO: 535084
  misc_feature: HIJSMM301BVS54.47.64.F09.1.454.light.4.raw

SEQ ID NO: 560313 - DNA, 515 bp, Homo sapiens; identical to SEQ ID NO: 536247
  misc_feature: HIJSMM301C6MKW.14.19.B08.1.454.light.4.raw

SEQ ID NO: 560314 - DNA, 484 bp, Homo sapiens; identical to SEQ ID NO: 540581
  misc_feature: HIJSMM301AQWUD.3.88.H11.1.454.light.4.raw

SEQ ID NO: 560315 - DNA, 484 bp, Homo sapiens; identical to SEQ ID NO: 538770
  misc_feature: HIJSMM301B7VQZ.4.57.F02.1.454.light.4.raw

SEQ ID NO: 560316 - DNA, 484 bp, Homo sapiens; identical to SEQ ID NO: 539927
  misc_feature: HIJSMM301BBWXY.15.1.A01.1.454.light.4.raw

SEQ ID NO: 560317 - DNA, 494 bp, Homo sapiens; identical to SEQ ID NO: 543462
  misc_feature: HIJSMM301ESHTH.12.38.D05.1.454.light.4.raw

SEQ ID NO: 560318 - DNA, 486 bp, Homo sapiens
  misc_feature: HIJSMM301CDLOC.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttcggccaaggaccgaacggtggaaatcaaacgaactagtggctgcaccta

SEQ ID NO: 560319 - DNA, 494 bp, Homo sapiens; identical to SEQ ID NO: 535828
  misc_feature: HIJSMM301DI0BG.3.36.D03.1.454.light.4.raw

SEQ ID NO: 560320 - DNA, 474 bp, Homo sapiens
  misc_feature: HIJSMM301BDW9R.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgacggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcactttcggcctggactgaagtgcatatgaagagaactgtggctgca

SEQ ID NO: 560321 - DNA, 454 bp, Homo sapiens; identical to SEQ ID NO: 534964
  misc_feature: HIJSMM301ELUZ6.19.86.H09.1.454.light.4.raw

SEQ ID NO: 560322 - DNA, 521 bp, Homo sapiens; identical to SEQ ID NO: 539470
  misc_feature: HIJSMM301EQ2GP.27.23.C01.1.454.light.4.raw

SEQ ID NO: 560323 - DNA, 505 bp, Homo sapiens; identical to SEQ ID NO: 546621
  misc_feature: HIJSMM301A1D41.15.86.H09.1.454.light.4.raw

SEQ ID NO: 560324 - DNA, 512 bp, Homo sapiens
  misc_feature: HIJSMM301COEW9.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccagggaccgaaggtcggaaagtacaaacgaaactaagtggcgtgcaccactctgtcttctactcttccccg

SEQ ID NO: 560325 - DNA, 482 bp, Homo sapiens
  misc_feature: HIJSMM301C3H9R.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacaggctgcccccaaccttcggccagggacacgactggagattaaacgaactgtggctgcaccatct

SEQ ID NO: 560326 - DNA, 495 bp, Homo sapiens; identical to SEQ ID NO: 535821
  misc_feature: HIJSMM301EY9MF.3.31.C09.1.454.light.4.raw

SEQ ID NO: 560327 - DNA, 513 bp, Homo sapiens; identical to SEQ ID NO: 546362
  misc_feature: HIJSMM301CH2DC.16.66.F11.1.454.light.4.raw

SEQ ID NO: 560328 - DNA, 494 bp, Homo sapiens
  misc_feature: HIJSMM301DANOI.49.55.E11.1.454.light.4.raw
agtcgagagacacgaccggtgctcgatttagcactcgcacgttgggtttggggactgctcagttaggacccagagggaaccatggaagccccagctcagtttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgggacagacttcactctcaccatcagcagcctagagcctgaagattttgcagtctattactgtcagcagcgttacaactggcctcccatgtacacttttggccaggggaccaagctggaaatcagacgaactgtggctgcaccatctgtctt

SEQ ID NO: 560329 - DNA, 500 bp, Homo sapiens
  misc_feature: HIJSMM301B9J89.51.21.B10.1.454.light.4.raw
cgatcgtatacacgaccggtgctcgatttagtgtcgtcgcaaggggagctgtgggctcagaagcagagttctggggtgtctccaccatggcctggacccctctctggctcactctcctcactctttgcataggttctgtggtttcttctgagttgactcaggaccctgctgtgtctgtggccttgggacagacagtcaggatcacatgccagggagacagcctcagaagttttttatgcaaactggtaccaacagaggccacgacagccccctacacttgtcatctatggtgaaaaaatcggccctcagggatcccagaccgattctctgcctccagctcaggaaacacagcttccttgatcatcgctggggctcaggcggaagatgaggctgactattactgtcactcccgggacagcagtagtcaccatttggaactattcggcggagggaccaagctgaccgtcctaggtcagcccaaggctgccccctcggtcact

SEQ ID NO: 560330 - DNA, 509 bp, Homo sapiens
  misc_feature: HIJSMM301BWCS5.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaaggtggaaggtcaagcgaactgtggctgcaccatctgtcttcatcttcccgcc

SEQ ID NO: 560331 - DNA, 440 bp, Homo sapiens; identical to SEQ ID NO: 543201
  misc_feature: HIJSMM301B6V9H.11.3.A03.1.454.light.4.raw

SEQ ID NO: 560332 - DNA, 519 bp, Homo sapiens
  misc_feature: HIJSMM301BWG0W.40.87.H10.1.454.light.4.raw
tctagcgactcacgaccggtgctcgatttagcagtactgcgttgggtttggggagcttcagctgtggtagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatttcttgttctggaagcaactccaatatcggaactaattatgtatactggtaccagcagctcccaggaacggcccccaaagtcctcttctataggaataatcaacggccctcaggggtccctgaccgattctctgcctccaagtctggcacctctgtgtccctggccatcagtgggctccggtccgaagatgagggtgactattactgtgcagcttgggatgagagcctgagaggttggctggttcggcgggagggaccaagctgaccgtcctaggtcagcccaaggctgccccctcggtcactc

SEQ ID NO: 560333 - DNA, 507 bp, Homo sapiens
  misc_feature: HIJSMM301BEQFX.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctggggacttcgttcactctcaccatcaataacctgcaatctgacgactttgcagtttatttctgtcagcagtctgaagactggccgttcactttcggcggagggaccaaggtggacctcaaacgaactgtggctgcaccatctgtcttcatcttcccgcc

SEQ ID NO: 560334 - DNA, 491 bp, Homo sapiens; identical to SEQ ID NO: 536211
  misc_feature: HIJSMM301EOMEA.16.53.E09.1.454.light.4.raw

SEQ ID NO: 560335 - DNA, 490 bp, Homo sapiens
  misc_feature: HIJSMM301AZGNU.3.33.C11.1.454.light.4.raw
agacgcactccacgaccggtgctcgatttagagtgagctcgttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccagacaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggct

SEQ ID NO: 560336 - DNA, 506 bp, Homo sapiens; identical to SEQ ID NO: 535058
  misc_feature: HIJSMM301AUJTZ.17.41.D08.1.454.light.4.raw

SEQ ID NO: 560337 - DNA, 507 bp, Homo sapiens
  misc_feature: HIJSMM301CWBJ9.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgttttcctgggagagagccaccctctcctgtgcggccagtcagagcgttaggacgaacttagcctggtatcagcagaggcctggccaggctcccagactcctcatctttggcgcctttacagggccagtggaatcccagccaggttcagcggcagtgggtctggggacttcgttcactctcaccatcaataacctgcaatctgacgactttgcagtttatttcttgtcagcagtctgaagactggccgttcactttcggcggagggaccaaggtggacctcaaacgaacctttggctgcaccatctgtcttcatcttcccgccat

SEQ ID NO: 560338 - DNA, 503 bp, Homo sapiens
  misc_feature: HIJSMM301B6CTB.47.55.E11.1.454.light.4.raw
agctcacgtacacgaccggtgctcgatttagcactcgcacgtagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctagggcacgtgagactcaggaaatgaccagaggggagtgaatgagggtgcagagaactccatggctaccaggtcagcccaaggccaaccccactgtcactctcgttcccaccctcctcta

SEQ ID NO: 560339 - DNA, 507 bp, Homo sapiens
  misc_feature: HIJSMM301BH6KW.47.83.H06.1.454.light.4.raw
agctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatactcccccagctggtaccagcagaccccgggccagactccacgcacgctcatctacaacacagacactcgctcttctggggtccctgatcgcttctctggttccatccttgggaacaaagctgccctcaccatcgcgggggcccaggcagatgatgagtgtgattattactgtgtgctctatatgggcagtggcgtttgggtgttcggcggagggaccaagctgaccgttcg

SEQ ID NO: 560340 - DNA, 486 bp, Homo sapiens
  misc_feature: HIJSMM301ANMYO.40.83.H06.1.454.light.4.raw
tctagcgactcacgaccggtgctcgatttagatcacgtgcgtcgcggggaaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttcagcatgggacggcagcctcagtgaatgggtgttcggcggagggaccaaactgtccgtcctaggtcagcccaac

SEQ ID NO: 560341 - DNA, 490 bp, Homo sapiens; identical to SEQ ID NO: 535234
  misc_feature: HIJSMM301ER0D8.17.21.B10.1.454.light.4.raw

SEQ ID NO: 560342 - DNA, 499 bp, Homo sapiens
  misc_feature: HIJSMM301B4NPR.53.38.D05.1.454.light.4.raw
cgcgtatacacacgaccggtgctcgatttagtatctgatagttgggtttgggggtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggcaaaacaatatggatattggtaccggcagaagccaggccaggcccctgtgttggtaatatataaagacagggagaggcccccagggatccctgagcgatactctggctccagctcagggacaacagtcacattgaccatcagtggagtccaggcagaagacgaggctgactattactgtcaatctgcggacagcagtggttctcatgtggtattcggcggagggaccaagctgaccgtcctaggtcagcccaaggctgccccctcggtcact

SEQ ID NO: 560343 - DNA, 472 bp, Homo sapiens; identical to SEQ ID NO: 536302
  misc_feature: HIJSMM301EDOXO.18.76.G10.1.454.light.4.raw

SEQ ID NO: 560344 - DNA, 494 bp, Homo sapiens; identical to SEQ ID NO: 534992
  misc_feature: HIJSMM301BRP9V.9.1.A01.1.454.light.4.raw

SEQ ID NO: 560345 - DNA, 506 bp, Homo sapiens
  misc_feature: HIJSMM301DZWOH.48.15.B04.1.454.light.4.raw
agtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaaactactcatttactcggcatccacccggaagtccgaggttcctgaccgattccgtggcagcgggtctgggacagattttactctcaccatcactaccctgcaggctgaagatgtggcagtttatactgtcaacaatattattctactccgccgacgttgccggggccgaacgtggaaatacaaacgaactagtggctgcaccatctgtcttcta

SEQ ID NO: 560346 - DNA, 493 bp, Homo sapiens; identical to SEQ ID NO: 536246
  misc_feature: HIJSMM301A7NOB.49.66.F11.1.454.light.4.raw

SEQ ID NO: 560347 - DNA, 513 bp, Homo sapiens
  misc_feature: HIJSMM301DNKZ9.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggtccaagggaccgaacggtggaaagtacaaacgaactagtggcgtgtcaccaactctgtcttctatcttccccg

SEQ ID NO: 560348 - DNA, 521 bp, Homo sapiens
  misc_feature: HIJSMM301A7LC5.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgtcctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccgccct

SEQ ID NO: 560349 - DNA, 501 bp, Homo sapiens
  misc_feature: HIJSMM301ECIIV.18.26.C04.1.454.light.4.raw
tacgagtatgcacgaccggtgctcgatttagtctagcgactttgggtttgggggggtcagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaagcccctaacctcctgatcaagggtccgtccagtttccagagtggggcctcaacaaggttcagcggcagtggatctgggacagatttcactctcaccatcaccagcctgcagcctgaagattttgcaacttactattgtcaacaggctgacaggttcccgctgactttcggcggagggaccaaggtagagatcaaaggaactgtggctgcaccatctgtcttcatcttcccgccta

SEQ ID NO: 560350 - DNA, 505 bp, Homo sapiens; identical to SEQ ID NO: 558614
  misc_feature: HIJSMM301DE5VL.8.19.B08.1.454.light.4.raw

SEQ ID NO: 560351 - DNA, 500 bp, Homo sapiens; identical to SEQ ID NO: 542309
  misc_feature: HIJSMM301BS2VV.12.86.H09.1.454.light.4.raw

SEQ ID NO: 560352 - DNA, 444 bp, Homo sapiens; identical to SEQ ID NO: 535027
  misc_feature: HIJSMM301A1J8V.8.73.G07.1.454.light.4.raw

SEQ ID NO: 560353 - DNA, 496 bp, Homo sapiens
  misc_feature: HIJSMM301EC9LN.43.16.B05.1.454.light.4.raw
tgtgagtagtcacgaccggtgctcgatttagagctcacgtaaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaacatcacttgccgggcaagtcagactatcaacacccatttaaattggtatcagcagaaacgagggaaagcccctaaactcctgatttatgttgcatccactttacaaactggggtcccatcaaggttcagtggcagtggatctggggcagatttcactctcaacatcggcagtgttcaacctgaagattttgcgacttattattgtcaacagagtcacagtttcccgtacacttttggccaggggaccaggctggagagcaaacgaactgtggctgcaccatctgtcttcatcttccccg

SEQ ID NO: 560354 - DNA, 516 bp, Homo sapiens
  misc_feature: HIJSMM301B4Q79.51.42.D09.1.454.light.4.raw
cgatcgtatacacgaccggtgctcgatttagacacatacgcagggaaagggggaagagctgctcagttaggacccagagggaaccatggaaaccccagcgcagcttctcttcctcctgctactctggctcccagatactaccggagaaattgtgttgacgcaatcgccaggcaccctgtctttgtctccaggggagagagccaccctctcttgcagggccagtcagactattggcatcaactacctagcctggtaccaacagaagcctggccaggctcccagactcctcctttttggtgcatccagcagggccactggcgtcccagacaggttcagtggcagtgggtctgggacagacttcgctctcaccatcagcagagtggagcctgaagattttgcagtgtattactgtcagcagtataatctactacctcggacgttcggtccgacggaccgaacggtaggaaagtacaaacgaactagtggcgtgcaccactctgtcttctatcttccccg

SEQ ID NO: 560355 - DNA, 489 bp, Homo sapiens; identical to SEQ ID NO: 535139
  misc_feature: HIJSMM301AMIBS.14.55.E11.1.454.light.4.raw

SEQ ID NO: 560356 - DNA, 519 bp, Homo sapiens
  misc_feature: HIJSMM301BW2YQ.14.78.H01.1.454.light.4.raw
cgtctagtaccacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgcaactaatggtgagattgggacttataaccttgtctcctggtaccaacaacatccagacaaagcccccaaactcatcatttatgagaccactaagcggccctcaggggtttctgatcgcttctctgcctccaagtctggccacacggcctccctgacaatctctgggctccagactgaggacgagggtgattattactgctgctcatacggagggactagaactttgctattcggcggagggaccaagttgaccgtcctaagtcagcccaaggctgccccctcggtcactctgttcccccg

SEQ ID NO: 560357 - DNA, 463 bp, Homo sapiens; identical to SEQ ID NO: 535062
  misc_feature: HIJSMM301AK959.11.73.G07.1.454.light.4.raw

SEQ ID NO: 560358 - DNA, 508 bp, Homo sapiens
  misc_feature: HIJSMM301DAGHH.18.78.H01.1.454.light.4.raw
  modified_base (468)..(468): a, c, t, g, unknown or other
tacgagtatgcacgaccggtgctcgatttagtgtgagtagtttgggtttgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtnacccccgtctaggtcagcccaaggccaaccccactgtcta

SEQ ID NO: 560359 - DNA, 497 bp, Homo sapiens; identical to SEQ ID NO: 536807
  misc_feature: HIJSMM301EGZV0.10.37.D04.1.454.light.4.raw

SEQ ID NO: 560360 - DNA, 454 bp, Homo sapiens
  misc_feature: HIJSMM301AXZQ0.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacactgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccaccctcctccacgagagta

SEQ ID NO: 560361 - DNA, 441 bp, Homo sapiens; identical to SEQ ID NO: 550529
  misc_feature: HIJSMM301BTVS5.41.9.A09.1.454.light.4.raw

SEQ ID NO: 560362 - DNA, 484 bp, Homo sapiens
  misc_feature: HIJSMM301B58JV.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggttttggtcgtgttcggcggcgggaccg

SEQ ID NO: 560363 - DNA, 516 bp, Homo sapiens
  misc_feature: HIJSMM301BC286.51.27.C05.1.454.light.4.raw
cgatcgtatacacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctcctggtaccaacaccacccaggcaaagcccccaaactcatgatttatgatgtcagtgatcggccctcaggggtttcgaatcgcttctctggctccaagtccggcaacacggcctccctgaccatctctgggctccaggccgaggacgaggctgattattactgcacctcatatacaagcagcaacaattgggtgttcggcggagggaccaagctgaccgtcctaggtcagcccgaggctgccccctcggtcactctgttcccc

SEQ ID NO: 560364 - DNA, 446 bp, Homo sapiens; identical to SEQ ID NO: 540475
  misc_feature: HIJSMM301CNLMZ.18.9.A09.1.454.light.4.raw

SEQ ID NO: 560365 - DNA, 491 bp, Homo sapiens
  misc_feature: HIJSMM301EQAQ8.40.37.D04.1.454.light.4.raw
tctagcgactcacgaccggtgctcgatttagtagcatactgttgggtttgggggatcaggacttctcagttcatcttctcaccatgaggctccctgctcagctcctggggctgctaatgctctggatccctggttccagtgcgagggttgtgatgactcagactccactctctctgtccgtcacccctggacagccggcctccatctcctgcaagtctgctcagagcctcctgcatggtgatggaatcacctatttatattggtacctgcagaagccaggccagtctccacagctcctaatctatgaggtttccagccggttctctggagtgccagataggttcagtggcagcgggtcagtgacagatttcacactgaaaatcagccgggtggaggctgaggatgttggggtttattactgcatgcaaggtttataccttcctcggactttcggtccctcggaccacgagtggatgtacaacgaactacgt

SEQ ID NO: 560366 - DNA, 484 bp, Homo sapiens; identical to SEQ ID NO: 560362
  misc_feature: HIJSMM301C6XNG.21.25.C03.1.454.light.4.raw

SEQ ID NO: 560367 - DNA, 488 bp, Homo sapiens; identical to SEQ ID NO: 535861
  misc_feature: HIJSMM301EBTI4.14.55.E11.1.454.light.4.raw

SEQ ID NO: 560368 - DNA, 555 bp, Homo sapiens
  misc_feature: HIJSMM301A1SIE.12.55.E11.1.454.light.4.raw
atacgacgtacacgaccggtgctcgatttagcactcgcacgttgggtttgggggtggtagctcaggaagcagagcctggagcatctccactatggcctgggctccactacttctcaccctcctcgctcactgcacaggttcttgggccagctttttgctgactcagccccactctgtgtcggggtctccggggaagacggtaaccatctcctgcaccggcagcagtggcaacattgccacgaagtatgtgcagtggtaccagcagcgcccgggcagtgcccccaccactataatctatgaggatgaccgacgaccctctggggtccctgatcgtttctctggctccatcgacagctcctccaattctgcctccctcaccatctctggactcatgtctgaggacgaggctgactactaccgtcagtcttattgagtaataacgtcttcgtttttttcggttttccgggtcgggaccggaacgacgtcgtaccggtcccgttaaccggtcgtacgacccgaaccggaacgtcgtcccccgtcccggttccgtacctt

SEQ ID NO: 560369 - DNA, 496 bp, Homo sapiens; identical to SEQ ID NO: 535423
  misc_feature: HIJSMM301DC07P.3.33.C11.1.454.light.4.raw

SEQ ID NO: 560370 - DNA, 493 bp, Homo sapiens; identical to SEQ ID NO: 535047
  misc_feature: HIJSMM301D6ERJ.16.53.E09.1.454.light.4.raw

SEQ ID NO: 560371 - DNA, 495 bp, Homo sapiens
  misc_feature: HIJSMM301ES4RP.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccgaagggaccgaaagtaggacgatcaagcgaactacgtggctgcaccaatct

SEQ ID NO: 560372 - DNA, 508 bp, Homo sapiens
  misc_feature: HIJSMM301BKXZT.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccggggccactttcggcccgtgggaccaaggtggagatcaaacgaactgtggctgcaccatctgtcttcta

SEQ ID NO: 560373 - DNA, 498 bp, Homo sapiens; identical to SEQ ID NO: 544837
  misc_feature: HIJSMM301D763H.11.71.G05.1.454.light.4.raw

SEQ ID NO: 560374 - DNA, 444 bp, Homo sapiens; identical to SEQ ID NO: 534993
  misc_feature: HIJSMM301CMMUO.5.9.A09.1.454.light.4.raw

SEQ ID NO: 560375 - DNA, 519 bp, Homo sapiens
  misc_feature: HIJSMM301EU84U.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggacaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccgaaggtggcaatcaaccgaactgtggctgcaccatctgtcttcatcttcccg

SEQ ID NO: 560376 - DNA, 484 bp, Homo sapiens; identical to SEQ ID NO: 539003
  misc_feature: HIJSMM301DFTX4.10.1.A01.1.454.light.4.raw

SEQ ID NO: 560377 - DNA, 350 bp, Homo sapiens; identical to SEQ ID NO: 537421
  misc_feature: HIJSMM301A937L.13.11.A11.1.454.light.4.raw

SEQ ID NO: 560378 - DNA, 476 bp, Homo sapiens
  misc_feature: HIJSMM301EQCWE.10.1.A01.1.454.light.4.raw
catagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagctcctctccgacaggaataacatccggccctcagggatctcagagagattctctgcatccaggtcaggaagcacagcctccctgaccattactggactccaggctgacgacgaagctgattattactgctcagcatgggacaccggcctcagtgcgtggttttcggcggagggaccaagctgaccgtcctaggtc

SEQ ID NO: 560379 - DNA, 476 bp, Homo sapiens; identical to SEQ ID NO: 537368
  misc_feature: HIJSMM301A7WDH.7.83.H06.1.454.light.4.raw

SEQ ID NO: 560380 - DNA, 497 bp, Homo sapiens; identical to SEQ ID NO: 539903
  misc_feature: HIJSMM301BRQ5T.11.71.G05.1.454.light.4.raw

SEQ ID NO: 560381 - DNA, 511 bp, Homo sapiens; identical to SEQ ID NO: 549024
  misc_feature: HIJSMM301D3VO2.14.7.A07.1.454.light.4.raw

SEQ ID NO: 560382 - DNA, 502 bp, Homo sapiens
  misc_feature: HIJSMM301DWHNC.47.55.E11.1.454.light.4.raw
agctcacgtacacgaccggtgctcgatttagcactcgcacgtagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctagggcacgtgagactcaggaaatgaccagaggggagtgaatgaggggtgcagagaactccatggctaccaggtcagcccaaggccaacccactgtcactctgttcccaccctcctcta

SEQ ID NO: 560383 - DNA, 490 bp, Homo sapiens; identical to SEQ ID NO: 538273
  misc_feature: HIJSMM301CG67U.16.73.G07.1.454.light.4.raw

SEQ ID NO: 560384 - DNA, 515 bp, Homo sapiens
  misc_feature: HIJSMM301AYU2G.47.23.C01.1.454.light.4.raw
agctcacgtacacgaccggtgctcgatttagtacacgtgattagggattggggctgggcctaaggaagcagcactggtggtgcctcagccatggcctggaccgttctcctcctcggcctcctctctcactgcacagactctgtggcctcctatgtactgactcagccatcctcggtggcagtggccccaggacagacggccaggattccctgtggaggaaacaacattggaagtaagagtgtacattggtaccaacagaggccaggccaggcccctgtgctggtcgtccatgatgatagcgaccggccctcagggatccctgagcgcttctctggctccaattctgggaacacggccaccctgaccatcagcgcggtcgaagccggagatgaggccgactattactgtcaggtgtgggacagtaatagtgatcccgagcaggttttcggcggtgggaccaagctgaccgtcctaagtcagcccaaggctgccccctccggtcactctgttccccg

SEQ ID NO: 560385 - DNA, 489 bp, Homo sapiens; identical to SEQ ID NO: 535139
  misc_feature: HIJSMM301A87Q2.14.55.E11.1.454.light.4.raw

SEQ ID NO: 560386 - DNA, 441 bp, Homo sapiens; identical to SEQ ID NO: 535074
  misc_feature: HIJSMM301CDI2D.11.3.A03.1.454.light.4.raw

SEQ ID NO: 560387 - DNA, 505 bp, Homo sapiens; identical to SEQ ID NO: 536254
  misc_feature: HIJSMM301CJ1P0.7.71.G05.1.454.light.4.raw

SEQ ID NO: 560388 - DNA, 508 bp, Homo sapiens
  misc_feature: HIJSMM301CFJ0O.13.73.G07.1.454.light.4.raw
tcacgtactacacgaccggtgctcgatttagctctacgctcaggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaacacccaggcaaagcccccaaactcattatttacggggtcaataagcggccctcagggctttctgatcgcttctctggctccaagtctggcaacacggcctccctgacaatctctggactccaggccgaggacgaggctgatttttactgttgttcatatgcaggaaggagtgattatgtctttggaagtgggaccaaggtcaccgtcttggtcagcccaaggccaacccactgtcactctgttccca

SEQ ID NO: 560389 - DNA, 497 bp, Homo sapiens; identical to SEQ ID NO: 538061
  misc_feature: HIJSMM301B3BBV.16.46.E02.1.454.light.4.raw

SEQ ID NO: 560390 - DNA, 499 bp, Homo sapiens
  misc_feature: HIJSMM301CDX2A.11.75.G09.1.454.light.4.raw
cgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccggttatggtatgctctggtatcaacaacgtccaggaatggcccccaaactcctcatctatgctgacaacaatcgaccttcagggtccctgaccggttctctggctccaagtctggctcttccgcctccttggccatcactgggctcgaggctgacgatgaggctgattactactgtctgtcctatgacgacgacctacagactccggttttcggccggagggactaagctgaccgtcctaagtcagcccaa

SEQ ID NO: 560391 - DNA, 506 bp, Homo sapiens
  misc_feature: HIJSMM301BYJTW.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctgggtcagcccaaggctcgccccctcggtcta

SEQ ID NO: 560392 - DNA, 509 bp, Homo sapiens
  misc_feature: HIJSMM301BLL53.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaaggctgaccgtcctaggtcagcccaaggctgtccccccg

SEQ ID NO: 560393 - DNA, 498 bp, Homo sapiens
  misc_feature: HIJSMM301EAQR4.3.10.A10.1.454.light.4.raw
agacgcactccacgaccggtgctcgatttagcgtcgatctcagggggaggaactgctcagttaggacccagacggaaccatggaagccccagcgcagcttctcttcctcctgctactctggctcccagatgccactggagaaatagtgatggcgcagtctccagccaccctgtctgtgtctccaggggaaagagccaccctctcctgcagggccagtcagtctgtttataacaacttagcctggtaccaacagagacctggccaggctcccaggctcctcatgtttggtgcttccaccagggccactggtatcccagccaggttcagtggcagtgggtctgggacagagttcactctcaccatcagcagcctgcagtctgaagattttgcaatttatttctgtcagcagtacaataattggcctttgacgttcggccaagggaccaaggtggaaactaacgaactgtggctgcaccatctgtcttcatcttccgccta

SEQ ID NO: 560394 - DNA, 444 bp, Homo sapiens
  misc_feature: HIJSMM301AL43V.10.76.G10.1.454.light.4.raw
  modified_base (426)..(426): a, c, t, g, unknown or other
catagtagtgcacgaccggtgctcgatttagtcactcatacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgttcccnccctcctccactactatg

SEQ ID NO: 560395 - DNA, 491 bp, Homo sapiens; identical to SEQ ID NO: 535194
  misc_feature: HIJSMM301D5040.26.78.H01.1.454.light.4.raw

SEQ ID NO: 560396 - DNA, 506 bp, Homo sapiens; identical to SEQ ID NO: 534969
  misc_feature: HIJSMM301BBDH8.18.37.D04.1.454.light.4.raw

SEQ ID NO: 560397 - DNA, 506 bp, Homo sapiens
  misc_feature: HIJSMM301AJQAV.18.26.C04.1.454.light.4.raw
tacgagtatgcacgaccggtgctcgatttagtctagcgactttgggtttgggggggtcgagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagactggttaatttggtatcagcagaaagcaggaaaagcccctaacctcctgatcaagggtccgtccagtttccagagtggggcctcaacaaggttcagcggcagtggatctgggacagatttcactctcaccatcaccagcctgcagcctgaagattttgcaacttactattgtcaacaggctgacaggttcccgctgactttcggcggagggaccaaggtaggagaatcaaaggaatcgtggctgcaccatctgtcttcatcttcccgctta

SEQ ID NO: 560398 - DNA, 490 bp, Homo sapiens; identical to SEQ ID NO: 535234
  misc_feature: HIJSMM301BZ9JE.17.21.B10.1.454.light.4.raw

SEQ ID NO: 560399 - DNA, 492 bp, Homo sapiens; identical to SEQ ID NO: 536087
  misc_feature: HIJSMM301A2D6O.10.17.B06.1.454.light.4.raw

SEQ ID NO: 560400 - DNA, 515 bp, Homo sapiens
  misc_feature: HIJSMM301B8C2N.12.85.H08.1.454.light.4.raw
atacgacgtacacgaccggtgctcgatttagtatcactcagtcgcgggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcaccatttcctgcaccggaaccaatagtgacgttggtcgttataactttgtctcctggtacaaacagcacccaggcaaagccccccaactcctgatttatgaggtcactattcggtcctcaggaatttctaatcgcttctctggttccaagtctggcaacacggcctccctgaccatctctggggtccaggctgaggacgaggctgattattactgcagttcatatacaagcacttccactctcgtggtgttcggcggtgggaccaagctgaccgtcctaagtcagcccaaggctgccccctcggtcactctcgttccc

SEQ ID NO: 560401 - DNA, 494 bp, Homo sapiens; identical to SEQ ID NO: 546323
  misc_feature: HIJSMM301ALHAH.51.59.F04.1.454.light.4.raw

SEQ ID NO: 560402 - DNA, 444 bp, Homo sapiens; identical to SEQ ID NO: 535192
  misc_feature: HIJSMM301BZ2MJ.5.9.A09.1.454.light.4.raw

SEQ ID NO: 560403 - DNA, 481 bp, Homo sapiens
  misc_feature: HIJSMM301B9IH8.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgaggattttgcaacttattactgtctacaagattacacttaccctgggacgttcggccaagggaccaaggtggaaagtcaaacgaactgtggctgcacca

SEQ ID NO: 560404 - DNA, 505 bp, Homo sapiens
  misc_feature: HIJSMM301EI3BZ.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaaggtggaaagtcaaacgaactagtggctgcaccatctgtcttcatcttccccg

SEQ ID NO: 560405 - DNA, 505 bp, Homo sapiens
  misc_feature: HIJSMM301D5B5R.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcgggcgttcggccaagggaccaaggtggaaatacaaacgaactagtggctgcaccatctgtcttcatcttccccg

SEQ ID NO: 560406 - DNA, 489 bp, Homo sapiens
  misc_feature: HIJSMM301CW404.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtggggtcccatcaaggttcagcggcagtgggtctgggacagaattcactctcaccatcagcagcctgcaacctgatgactttgcaacttattactgccaacagtataatggttatgaatccattttggccaagggaccaagctggagatcaaacgaactgtggctgcaccta

SEQ ID NO: 560407 - DNA, 503 bp, Homo sapiens
  misc_feature: HIJSMM301A1ESN.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatacgaactgacaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggtccaagggaccgaacggtaggagtaattcacgacgaactagt

SEQ ID NO: 560408 - DNA, 485 bp, Homo sapiens
  misc_feature: HIJSMM301BCGES.5.40.D07.1.454.light.4.raw
atcagacacgcacgaccggtgctcgatttagtgatagagcgtaacaacagaggggggaactgctcagttaggacccagacggaaccatggaagccccagcgcagcttctcttcctcctgctactctggctcccagataccattggagagatagtgatgacgcagtctccagccaccctgtctgtgtctccaggggaaagagccaccctctcctgcagggccagccagagtgtaagtagtaggttagcctggtatcagcagaaacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcaacagtataatgactggtggacgttcggccaagggaccaaggtggagaccaaacgaactgtggctgcaccatct

SEQ ID NO: 560409 - DNA, 513 bp, Homo sapiens; identical to SEQ ID NO: 541387
  misc_feature: HIJSMM301AUOU5.17.33.C11.1.454.light.4.raw

SEQ ID NO: 560410 - DNA, 512 bp, Homo sapiens
  misc_feature: HIJSMM301DOVBZ.15.86.H09.1.454.light.4.raw
tctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctcggtcactctgttcccaccctcctcgctacgtaga

SEQ ID NO: 560411 - DNA, 501 bp, Homo sapiens; identical to SEQ ID NO: 550139
  misc_feature: HIJSMM301B8NYO.15.56.F01.1.454.light.4.raw

SEQ ID NO: 560412 - DNA, 494 bp, Homo sapiens
  misc_feature: HIJSMM301EAC98.53.31.C09.1.454.light.4.raw
cgcgtatacacacgaccggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaacaatatgcttactggtaccagcagaggccaggccaggcccctgtcttggtgatttataaagactttgagaggccctcagggacccctgagcgattctctggctccagctcagggacaacagtcaccttgaccatcagtggagtccggccagaggacgaggctgactattactgtcagtccgcagacagcagtggcagttatgtcgtattcggcggagggactacgctgaccgtcctaggtcagcccaaggctgccccctc

SEQ ID NO: 560413 - DNA, 492 bp, Homo sapiens; identical to SEQ ID NO: 539815
  misc_feature: HIJSMM301DZ7AN.51.81.H04.1.454.light.4.raw

SEQ ID NO: 560414 - DNA, 477 bp, Homo sapiens
  misc_feature: HIJSMM301EXWJG.26.72.G06.1.454.light.4.raw
agactatactcacgaccggtgctcgatttagctacgactgcaagggaaagggtgagatccctcactgtggctcactttcagcggagggaccacggtggagatcacacgtaagtgcactttcctaatgctttttcttataaggttttaagtttggagcgtttttgtgtttgagatgttagctcaggtcaaattccaaagagtaccagattctttcaaaagtcagatgagtaagggatagaaaattagttcaccttaaggaacagccaagcgctagccagttaagtgaggcatctcaattgcaaggttttctctgcatcggtcaggttagtgatattaacagcgaaaagagatttttgttaaggggaaataatgaagttaacactgtggatcaccttcggccaagggacacgactggagattaaacgaactgtggctgcaccatctgtcttcatcttcccgccatctgaagtatagtct

SEQ ID NO: 560415 - DNA, 487 bp, Homo sapiens; identical to SEQ ID NO: 538190
  misc_feature: HIJSMM301BN5H2.47.70.G04.1.454.light.4.raw

SEQ ID NO: 560416 - DNA, 495 bp, Homo sapiens; identical to SEQ ID NO: 549785
  misc_feature: HIJSMM301DK8A6.12.38.D05.1.454.light.4.raw

SEQ ID NO: 560417 - DNA, 488 bp, Homo sapiens
  misc_feature: HIJSMM301C96LJ.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgcccctcggtcactctgttcccgccctcctccga

SEQ ID NO: 560418 - DNA, 506 bp, Homo sapiens; identical to SEQ ID NO: 534969
  misc_feature: HIJSMM301CMYDM.18.37.D04.1.454.light.4.raw

SEQ ID NO: 560419 - DNA, 504 bp, Homo sapiens
  misc_feature: HIJSMM301D0I9Z.19.78.H01.1.454.light.4.raw
tactctcgtgcacgaccggtgctcgatttagtgtgagtagtttgggtttgggggggtcacaagaggcagtgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaacccactgtca

SEQ ID NO: 560420 - DNA, 479 bp, Homo sapiens
  misc_feature: HIJSMM301DYX9Z.48.28.C06.1.454.light.4.raw
agtatacatacacgaccggtgctcgatttagagctcacgtattgggtttggggtgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagcccaac

SEQ ID NO: 560421 - DNA, 483 bp, Homo sapiens
  misc_feature: HIJSMM301A2RD5.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtgtggcccgctcattttcggcggagggaccaaggtgcagatcaaacgaactgtggctgca

SEQ ID NO: 560422 - DNA, 494 bp, Homo sapiens; identical to SEQ ID NO: 534992
  misc_feature: HIJSMM301AF102.9.1.A01.1.454.light.4.raw

SEQ ID NO: 560423 - DNA, 456 bp, Homo sapiens
  misc_feature: HIJSMM301DKD3A.18.78.H01.1.454.light.4.raw
tacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaaagtcttcggaactgggaccaaggtcaccgtcctaggtcagcccaaggccaaaccccactgtcactctgttcccgccctcctccatactcgta

SEQ ID NO: 560424 - DNA, 494 bp, Homo sapiens
  misc_feature: HIJSMM301B4KG9.14.55.E11.1.454.light.4.raw
  modified_base (451)..(451): a, c, t, g, unknown or other
  modified_base (456)..(456): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtaccccctctacttcgtcggaggacgacgacggngagtnacgacgaactagtggcgtcgtcaccactctcgtcttct

SEQ ID NO: 560425 - DNA, 477 bp, Homo sapiens
  misc_feature: HIJSMM301CFGWT.18.53.E09.1.454.light.4.raw
tacgagtatgcacgaccggtgctcgatttagagagagtgtgttgggtttggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaacagggaaagcccctaagctcctgatctatgctacatccagtttgcaaagtggggtcccatcaaggttcagtggcagtggatctgggacagatttcactctcaccatcagcagtctgcaacctgaagattttgcaacttactactgtcaacagagttacagtacccgtcgtacttttggccagggaccaagctggagatcaaacgaactgtggctgcacc

SEQ ID NO: 560426 - DNA, 506 bp, Homo sapiens; identical to SEQ ID NO: 534969
  misc_feature: HIJSMM301EC6CV.18.37.D04.1.454.light.4.raw

SEQ ID NO: 560427 - DNA, 506 bp, Homo sapiens
  misc_feature: HIJSMM301BAERD.19.78.H01.1.454.light.4.raw
tactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcaacccaaataaagcccccaaactcatcatttatgatgccactaagcggccctcaggggtttctaatcgcttctctggctccaagtctggcaacacggcctcctgacaatctctgggctccaggctgaggacgaggctgattactactgctgctcatatgcaggtcgtatctcttatgtcttcggaactgggaccaaggtcaccgtcctaggtcagcccaaggcccaacccactgtcta

SEQ ID NO: 560428 - DNA, 448 bp, Homo sapiens
  misc_feature: HIJSMM301C5HQA.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccaccctcctccatacctcgta

SEQ ID NO: 560429 - DNA, 487 bp, Homo sapiens; identical to SEQ ID NO: 535583
  misc_feature: HIJSMM301CBRXW.22.73.G07.1.454.light.4.raw

SEQ ID NO: 560430 - DNA, 495 bp, Homo sapiens; identical to SEQ ID NO: 538434
  misc_feature: HIJSMM301DDGSY.51.81.H04.1.454.light.4.raw

SEQ ID NO: 560431 - DNA, 377 bp, Homo sapiens; identical to SEQ ID NO: 536071
  misc_feature: HIJSMM301A97P8.40.9.A09.1.454.light.4.raw

SEQ ID NO: 560432 - DNA, 486 bp, Homo sapiens; identical to SEQ ID NO: 535385
  misc_feature: HIJSMM301BDIG5.19.71.G05.1.454.light.4.raw

SEQ ID NO: 560433 - DNA, 503 bp, Homo sapiens; identical to SEQ ID NO: 538884
  misc_feature: HIJSMM301CX51L.27.78.H01.1.454.light.4.raw

SEQ ID NO: 560434 - DNA, 483 bp, Homo sapiens
  misc_feature: HIJSMM301C675L.17.26.C04.1.454.light.4.raw
cgtagactagcacgaccggtgctcgatttagtctagcgactttgggtttggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttcagtggcagtggatctgggacagatttcactctcaccatcagcagtctgcaacctgaagattttgcaacttactactgtcaacagagttacaatacccctcggctcactttcggcggagggaccaaggtggagatcaaacgaactgtggctgcac

SEQ ID NO: 560435 - DNA, 505 bp, Homo sapiens
  misc_feature: HIJSMM301DX10M.9.53.E09.1.454.light.4.raw
tgatacgtctcacgaccggtgctcgatttagagagagtgtgttggggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggaccaaggtgaccgtcctaggtcagcccaaggctgccccccg

SEQ ID NO: 560436 - DNA, 498 bp, Homo sapiens
  misc_feature: HIJSMM301AJGQH.40.62.F07.1.454.light.4.raw
tctagcgactcacgaccggtgctcgatttagtagtcgcataaagggaaagggggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggaccttcggccacgggaccgacgggtgggaaagtacaaacgaactacgtggcgtgcaccactctgtc

SEQ ID NO: 560437 - DNA, 502 bp, Homo sapiens
  misc_feature: HIJSMM301DH4RA.12.48.E04.1.454.light.4.raw
atacgacgtacacgaccggtgctcgatttagagagcgtcacagagagaaggggagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatttcttgttctggaacccactccaacatcggatataattctgtagactggtaccagcagcttccaggagcggccccccgactcctcatctttaataacaatcagcggccctcaggggtccctgaccgattctctggctccaagtctggcacctcagcctccctggccatcagtgggctccagtctgaggatgaggctgattattactgtgcatcatgggctgaccaccctgactggtccgggagtgttcggcggagggaccaagctgaccgtcctaggtcagcccaa

SEQ ID NO: 560438 - DNA, 489 bp, Homo sapiens
  misc_feature: HIJSMM301DO2X4.11.12.B01.1.454.light.4.raw
cgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccccctgtcctactcatctttcaaaataccaggcggccctctggggtccctgagcgattctccggctccggctctgggaacacagtcactctgaccatcagcgggacccaggctattgatgaggctgtctacttctgtcaggcgtgggacaacagcgtggtgttcggcggagggaccagtctgaccgtctaggtcagcccaagg

SEQ ID NO: 560439 - DNA, 486 bp, Homo sapiens; identical to SEQ ID NO: 535043
  misc_feature: HIJSMM301EMAO7.46.35.D02.1.454.light.4.raw

SEQ ID NO: 560440 - DNA, 384 bp, Homo sapiens; identical to SEQ ID NO: 547883
  misc_feature: HIJSMM301C3TIA.48.35.D02.1.454.light.4.raw

SEQ ID NO: 560441 - DNA, 487 bp, Homo sapiens; identical to SEQ ID NO: 539157
  misc_feature: HIJSMM301BH1G9.26.37.D04.1.454.light.4.raw

SEQ ID NO: 560442 - DNA, 505 bp, Homo sapiens; identical to SEQ ID NO: 538054
  misc_feature: HIJSMM301AGEKR.8.55.E11.1.454.light.4.raw

SEQ ID NO: 560443 - DNA, 511 bp, Homo sapiens
  misc_feature: HIJSMM301BFEX3.48.34.D01.1.454.light.4.raw
agtatacatacacgaccggtgctcgatttagatcgtctgtgttgggtttgggggtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctgttcccaccct

SEQ ID NO: 560444 - DNA, 454 bp, Homo sapiens
  misc_feature: HIJSMM301EM946.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctggaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcgcaaggctgcccctcggtcactctgttcccaccctcctccacgagagta

SEQ ID NO: 560445 - DNA, 416 bp, Homo sapiens; identical to SEQ ID NO: 536892
  misc_feature: HIJSMM301EVY9O.16.46.E02.1.454.light.4.raw

SEQ ID NO: 560446 - DNA, 447 bp, Homo sapiens; identical to SEQ ID NO: 535201
  misc_feature: HIJSMM301CY8WL.18.9.A09.1.454.light.4.raw

SEQ ID NO: 560447 - DNA, 487 bp, Homo sapiens; identical to SEQ ID NO: 544685
  misc_feature: HIJSMM301B710V.15.28.C06.1.454.light.4.raw

SEQ ID NO: 560448 - DNA, 494 bp, Homo sapiens; identical to SEQ ID NO: 534992
  misc_feature: HIJSMM301BS139.9.1.A01.1.454.light.4.raw

SEQ ID NO: 560449 - DNA, 518 bp, Homo sapiens
  misc_feature: HIJSMM301D5B7Q.22.30.C08.1.454.light.4.raw
acatacgcgtcacgaccggtgctcgatttagtctgacgtcaaagggaaaggggagagctctggggagtctgcaccatggcttggaacccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggctgccccctcggtcactctgttcccaccctcctcacg

SEQ ID NO: 560450 - DNA, 483 bp, Homo sapiens
  misc_feature: HIJSMM301DEMGZ.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctcctgtctgcatctcttggagacagagtcaccgtcacttgccgggcgagtcacgacattaacacttatttagcctggtatcagcagaagccagggagagtccctaaattattgatctctgctgcgtccgccttgcaatcggggtcccatctcggttcagtggcggtggatctaggacagaattcactctcaccatcaccaacctgcaccctgaagatgttggaagttattactgtcagacctatagtggtgcccgctctattttcggcggtagggaccaaggtgcagatcaaacgaactgtggctgca

SEQ ID NO: 560451 - DNA, 497 bp, Homo sapiens; identical to SEQ ID NO: 535286
  misc_feature: HIJSMM301AI4YI.18.59.F04.1.454.light.4.raw

SEQ ID NO: 560452 - DNA, 498 bp, Homo sapiens
  misc_feature: HIJSMM301APDDR.27.78.H01.1.454.light.4.raw
agcgtcgtctcacgaccggtgctcgatttagtgtgagtagtttgggtttgggggatgagcaaaactagacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaatgatcaccttcggccaagggacacgactggagaattaaacgaaactgtggctgcaccatcctgtctt

SEQ ID NO: 560453 - DNA, 404 bp, Homo sapiens
  misc_feature: HIJSMM301D4Q1Q.4.35.D02.1.454.light.4.raw
agcactgtagcacgaccggtgctcgatttagcacacgatagttgggtttggggtttcatgagtgcagggagacggccaggattacttgtgggggagacaacattggagataaaagtgtgcactggtaccagcagaagccaggccaggcccctctgatggtcatctatttcgatagcgaccggccctcaggaatccctgcgcgattctcggggtccaactctgggagcacggccaccctgaccatcagtagtgtcgaagccggtgatgaggccgactatttctgtcaggtgtgggctactcgcagtgacctctgcgtcttcggaagtgggaccaaggtcaccgtcttaggtcagcccaaggccaaccccactgtcactctgttcccatcttcctcctacagtgct

SEQ ID NO: 560454 - DNA, 509 bp, Homo sapiens
  misc_feature: HIJSMM301B7VVC.48.27.C05.1.454.light.4.raw
agtatacatacacgaccggtgctcgatttagacgcgatcgaagggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctttgaggacaacaaacgaccctccgggatccctgagagattctctggctccagctcagggacaatggccaccttgactatcaatggggcccaggtggacgatgaggctgactactactgttcctcaacagacagtagtggtgatcggagggctgttcggcggagggaccaagctgaccgtcctaagtcagcccaaggctgccccctcggtcactctgttccccg

SEQ ID NO: 560455 - DNA, 464 bp, Homo sapiens
  misc_feature: HIJSMM301C33Q2.11.73.G07.1.454.light.4.raw
cgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctgatctacgatgcgtccaatttggaaacagaggtcccaccgaggttcagtggaagtggatctgggacagactttactctcaccatcagcagcctgcagcctgaagatattgcaacatattactgtcaacagtatgatcgtctcctcaatttcggccctgggacccagagtggacatgaaacgaa

SEQ ID NO: 560456 - DNA, 549 bp, Homo sapiens
  misc_feature: HIJSMM301CU64A.17.33.C11.1.454.light.4.raw
cgtagactagcacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttaggggtcgactcaccctgccccgattaacgttggacaggaacccttggtcttccggcgagcgggctttcgacccgacgttactcgttaacttatgtcagcattcgcacttctgtatacctccagcatgcctcacagcacaccttcacaggcttacagaacgctcccctaccaacaacgcataagcgtcgctgccgcagcttcggtgacatggtttacgccccgtttcatcttcccgccatctgact

SEQ ID NO: 560457 - DNA, 503 bp, Homo sapiens
  misc_feature: HIJSMM301DO5I0.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaaacatgggatgacaatctgagcggttgggtgttcggcggagggaccaaatggaccgtcctaggtcagcccaa

SEQ ID NO: 560458 - DNA, 494 bp, Homo sapiens; identical to SEQ ID NO: 536974
  misc_feature: HIJSMM301AINVK.16.86.H09.1.454.light.4.raw

SEQ ID NO: 560459 - DNA, 494 bp, Homo sapiens; identical to SEQ ID NO: 534994
  misc_feature: HIJSMM301DLQ3W.27.78.H01.1.454.light.4.raw

SEQ ID NO: 560460 - DNA, 502 bp, Homo sapiens; identical to SEQ ID NO: 557696
  misc_feature: HIJSMM301EQ1GY.22.15.B04.1.454.light.4.raw

SEQ ID NO: 560461 - DNA, 491 bp, Homo sapiens
  misc_feature: HIJSMM301ANUS5.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagaacaacagtaaatacttaatctttatgtcttcggatctggaccagggtcaccgtcctacggtcagcccaacggcaaccccca

SEQ ID NO: 560462 - DNA, 498 bp, Homo sapiens
  misc_feature: HIJSMM301AR841.40.54.E10.1.454.light.4.raw
tctagcgactcacgaccggtgctcgatttagatcgtagcagaacacacaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccagcatcacctgctctggagattcattgtcaaagcaatatgcttattggtaccagcagaaaccaggccaggcccctgtggtggtgctatataaagacactgagaggccctcagggacccctgagcgattctctggctccaggtcagggacaacagtcacgttgaccatcagtggagtccaggcagaagacgaggctgactattactgtcaatcagcagacagcagtggtacttttcgggttttcggtcggagggaccaagctgaccgtcctaggtcagcccaaggctgccccccg

SEQ ID NO: 560463 - DNA, 495 bp, Homo sapiens
  misc_feature: HIJSMM301EEWQ4.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgccccaattactactgtcaacagagttacagtacccccctcactttcggcggacgggaccgaaggacggagatacagacgaactgtggctgcaccatctgtcttcta

SEQ ID NO: 560464 - DNA, 492 bp, Homo sapiens
  misc_feature: HIJSMM301AD4WL.3.72.G06.1.454.light.4.raw
agacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccaggggaaagagccactctctcctgcagggccagtcagagtgttagcagctacttagcctggtaccagcagaaacctggccaggctcccaggctcctcatttatgatgcatccaacagggccactggcatcccagccaggttcagtggcagtgggtctgggacagacttcactctcaccatcagcagcctagagcctgaagattttgcagtttattactgtcagcagcgtagcaactggcctctcaccttcggcgggagggaccaaggtggagatcaaacgaactgtggctgcaccatctgtt

SEQ ID NO: 560465 - DNA, 490 bp, Homo sapiens
  misc_feature: HIJSMM301EKR7G.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtggggtcccatcaaggttcagcggcagtgggtctgggacagaattcactctcaccatcagcagcctgcaacctgatgactttgcaacttattactgccaacagtataatggttatgaattccacttttggccaagggaccaagctggagatcaaacgaactgtggctgcacca

SEQ ID NO: 560466 - DNA, 487 bp, Homo sapiens; identical to SEQ ID NO: 556287
  misc_feature: HIJSMM301B9XBU.10.2.A02.1.454.light.4.raw

SEQ ID NO: 560467 - DNA, 482 bp, Homo sapiens
  misc_feature: HIJSMM301DQXLB.43.50.E06.1.454.light.4.raw
tgtgagtagtcacgaccggtgctcgatttagatctactgacaacacacaagggggcaggagtcagtctcagtcaggacacagcatggacatgagggtccccgctcagctcctggggctcctgctactctggctccgaggtgccagatgtgacatccagatgacccagtctccatcctccctgtctgcatctgtcggagacagagtcaccatcacttgccgggcaagtcagagcattaggacctatctaaattggtatcagcagaaaccagggaaagtccctgaggtcctcatctatggtgcatccagtttgccaagtggggtcccagcaaggttcagtggcagtggatctgggacagatttcactctcaccatcagcagtctacaacctgaagattttgcaacttactactgtcaacagagtttcagtacccctctgacgttcggccaaggaccgaaggtggaaaataaaacgaaactgtgg

SEQ ID NO: 560468 - DNA, 486 bp, Homo sapiens; identical to SEQ ID NO: 535385
  misc_feature: HIJSMM301CSRK9.19.71.G05.1.454.light.4.raw

SEQ ID NO: 560469 - DNA, 478 bp, Homo sapiens; identical to SEQ ID NO: 535129
  misc_feature: HIJSMM301AT2N7.11.11.A11.1.454.light.4.raw

SEQ ID NO: 560470 - DNA, 508 bp, Homo sapiens
  misc_feature: HIJSMM301AD6AA.17.41.D08.1.454.light.4.raw
cgtagactagcacgaccggtgctcgatttagtcacgcgagaaagggaaaggggagagctgctcagttaggacccagagggaaccatggaaaccccagcgcagcttctcttcctcctgctactctggctcccagataccaccggagaaattgtgttgacgcagtctccaggcaccctgtccttgtctccaggggaaacagccaccctctcctgtagggccagtcagagtgtttttaaaaactatttagcctggtaccaacagaagcctggccaggctcccaggctcctcatctatggtgcatccaccagggccactggcatcccagacaggttcagtggcggtgggtctgggacagaattcactctcaccatcaccagtctggagcctgaagattttgctctgtatcactgtcagcaatatggtggtacacccctcactttcggcggacggggccgaaggtggagatcaagcgaactgtggctgcaccatctgtcttcatcttcccgcc

SEQ ID NO: 560471 - DNA, 534 bp, Homo sapiens
  misc_feature: HIJSMM301A77ZQ.18.26.C04.1.454.light.4.raw
tacgagtatgcacgaccggtgctcgatttagtctagcgactttgggtttgggggggtcagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaaagcccctaacctcctgatcaagggtccgtccagtttccagagtggggcctcaacaaggttcagcggcagtggatctgggacagatttcactctcaccatcaccagcctgcagcctgaagattttgcaacttactattgtcaacaggcgtgacaggttacccgtcctcgactttcggtcgggacgggacggaacggtaaggtaggagtactaaaggaaaacgtagtggcgtcgcgaccaactctcgtctttcctatcttcccgtcccta

SEQ ID NO: 560472 - DNA, 519 bp, Homo sapiens
  misc_feature: HIJSMM301DIICV.5.27.C05.1.454.light.4.raw
atcagacacgcacgaccggtgctcgatttagacgcgatcgaagggtttggggctgggcctaaggaagcagcactggtggtgcctcagccatggcctggacctttctcctccccggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgttcccaccctcctccgtgt

SEQ ID NO: 560473 - DNA, 501 bp, Homo sapiens
  misc_feature: HIJSMM301DA0F9.17.27.C05.1.454.light.4.raw
cgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtcatttatggtaagaataaccggccctcagggatcccagaccgattctctggctccgactcaggaaagacagcttccctgaccatcactggggctcaggcggaagatgaggctgactattactgtaactccgggacagcagtgctgaccaggtggtattcggcggagggacccacctgaccgtcttaggtcagcccaaggctgccccctcggtcta

SEQ ID NO: 560474 - DNA, 490 bp, Homo sapiens
  misc_feature: HIJSMM301EL0OI.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaggcggagagtcagacgaactgtggctgcaccatctgtcttcta

SEQ ID NO: 560475 - DNA, 521 bp, Homo sapiens; identical to SEQ ID NO: 539470
  misc_feature: HIJSMM301AIP9H.27.23.C01.1.454.light.4.raw

SEQ ID NO: 560476 - DNA, 508 bp, Homo sapiens; identical to SEQ ID NO: 550253
  misc_feature: HIJSMM301C8TQJ.9.55.E11.1.454.light.4.raw

SEQ ID NO: 560477 - DNA, 521 bp, Homo sapiens; identical to SEQ ID NO: 538715
  misc_feature: HIJSMM301AN6HA.27.23.C01.1.454.light.4.raw

SEQ ID NO: 560478 - DNA, 508 bp, Homo sapiens
  misc_feature: HIJSMM301CTTN8.12.48.E04.1.454.light.4.raw
atacgacgtacacgaccggtgctcgatttagagagcgtcacagagagaaggggggggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatttcttgttctggaacccactccaacatcggatataattctgtagactggtaccagcagcttccaggagcggccccccgactcctcatctttaataacaatcagcggccctcaggggtccctgaccgattctctggctccaagtctggcacctcagcctccctggccatcagtgggctccagtctgaggatgaggctgattattactgtgcatcatgggctgacacctgactggtccggagtgttcggcggagggaccaagctgaccgtcctaggtcagcccaaggcagccccctcggtcactc

SEQ ID NO: 560479 - DNA, 443 bp, Homo sapiens
  misc_feature: HIJSMM301C5PTT.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgttccaccctcctcgacacgcgag

SEQ ID NO: 560480 - DNA, 501 bp, Homo sapiens
  misc_feature: HIJSMM301D6FIV.15.1.A01.1.454.light.4.raw
tctacgtagccacgaccggtgctcgatttagacgtctcatcgaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctggtcact

SEQ ID NO: 560481 - DNA, 487 bp, Homo sapiens
  misc_feature: HIJSMM301CHRQ0.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaagtggggtcccatcaaggttcagcggcagtgggtctgggacagaattcactctcaccatcagcagcctgcaacctgatgactttgcaacttattactgccaacagtataatggttatgaatccacttttggccaagggaccaagctggagatcaaacgaactgtggctgcacc

SEQ ID NO: 560482 - DNA, 497 bp, Homo sapiens; identical to SEQ ID NO: 536371
  misc_feature: HIJSMM301CJ4ZX.16.78.H01.1.454.light.4.raw

SEQ ID NO: 560483 - DNA, 485 bp, Homo sapiens
  misc_feature: HIJSMM301AP8Y8.47.78.H01.1.454.light.4.raw
agctcacgtacacgaccggtgctcgatttagtgtgagtagtttgggtttgggaacctatgaacattctgtaggggccactgtcttctccacggtgctcccttcatgcgtgactcagccaccctcagcgtctgggacccccgggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcagcctccctggccatcagtgggctccggtccgaggatgaggctgattattattgtgcaacatgggatagtagcctgagtagtgtggttttcggcggagggaccaaactagacgtcctaggtcagcccaaggctgccccctccggtcactctgttcccaccctcctctactgagct

SEQ ID NO: 560484 - DNA, 508 bp, Homo sapiens
  misc_feature: HIJSMM301BDFFE.3.79.H02.1.454.light.4.raw
agacgcactccacgaccggtgctcgatttagtgtcacacgaagggaaaggggggggtcgtcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgattttttatatctctgtctcctggtaccaacaacacccaggcaaagcccccaaactcatcatttatgatgtcactgctcggccctcaggggtttctcatcgcttttctggctccaagtctggcaccacggcctccctgaccatctcggggctccaggctgaggacgaggctgcttattactgcagctcatatacaaggagcaccactctcgtggtatttggtggagggaccaagctgaccgtcctaggtcagcccaaggctgccccctcggt

SEQ ID NO: 560485 - DNA, 491 bp, Homo sapiens
  misc_feature: HIJSMM301AD9R4.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcctgcaagctctacaagtcccgctcactttcggtcggagggaccgaaggtggagatcaaacgaactagt

SEQ ID NO: 560486 - DNA, 480 bp, Homo sapiens; identical to SEQ ID NO: 553617
  misc_feature: HIJSMM301DU63L.3.38.D05.1.454.light.4.raw

SEQ ID NO: 560487 - DNA, 494 bp, Homo sapiens
  misc_feature: HIJSMM301DMLTQ.14.5.A05.1.454.light.4.raw
cgtctagtaccacgaccggtgctcgatttagatagatagacaggggggaactgctcagttaggacccagagggaaccatggaagccccagctcagcttctcttcctcctgctactctggctcccagataccaccggagaaattgtgttgacacagtctccaggcaccctgtccttgtctccaggggaaagagccaccctctcctgcagggccagtcagagtgttgatacgtacttagcctggtaccaacagaaacctggccaggctcccaggctcctcatctatgatgcatccatcagggccactggcatcccagccaggttcagtggcagtgggtctgggacagacttcactctcaccatcagcagcctagagcctgaagattttgcagtttattactgtcagcagcgtaccaactggcctcctgcgctcactttcggcggagggaccgaaggtggagatcaaacgaactgtggctgcaccatctgtcttcta

SEQ ID NO: 560488 - DNA, 447 bp, Homo sapiens
  misc_feature: HIJSMM301CSQ3B.18.73.G07.1.454.light.4.raw
tacgagtatgcacgaccggtgctcgatttagctctacgctcagggtcctgggcccagtctgggctgacgcagccgccctcactgtctggggccccagggcagagggtcagcatcaactgcactgggaccagttccaacatcggggcaaattatgatgtacactggtaccagcaacttccaggaacagcccccaaacttgtcatctatggtaacaataatcggccctcaggggtccctgcccgattctctggctccaagtctggcacctcagcctccctggccatcactgggctccaggctgatgatgaggctgattattactgccagtcctatgacactaatctcagtggtctgggggtcttcggcggagggaccaggctgaccgtcgtgggtcagcccaaggctgccccctcggtcactctgttcccaccctcctccatactcgta

SEQ ID NO: 560489 - DNA, 480 bp, Homo sapiens; identical to SEQ ID NO: 535630
  misc_feature: HIJSMM301A8BKB.40.59.F04.1.454.light.4.raw

SEQ ID NO: 560490 - DNA, 494 bp, Homo sapiens; identical to SEQ ID NO: 539922
  misc_feature: HIJSMM301ECURC.27.78.H01.1.454.light.4.raw

SEQ ID NO: 560491 - DNA, 485 bp, Homo sapiens; identical to SEQ ID NO: 540759
  misc_feature: HIJSMM301DT8OY.10.53.E09.1.454.light.4.raw

SEQ ID NO: 560492 - DNA, 485 bp, Homo sapiens; identical to SEQ ID NO: 546273
  misc_feature: HIJSMM301A00IM.43.36.D03.1.454.light.4.raw

SEQ ID NO: 560493 - DNA, 502 bp, Homo sapiens
  misc_feature: HIJSMM301CCHMZ.41.18.B07.1.454.light.4.raw
tctatactatcacgaccggtgctcgatttagtcgctgcgtaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagtagtggtccttatcgggtgttcggcgggggaccgaagctgaccgtcctaggtcagcccaaggctgccccctcggtcactctgttcccgt

SEQ ID NO: 560494 - DNA, 500 bp, Homo sapiens
  misc_feature: HIJSMM301E3CRG.19.78.H01.1.454.light.4.raw
tactctcgtgcacgaccggtgctcgatttagtgtgagtagtttgggtttgggggctttatttgggctctgctgctcctcactctactcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccactgtcactctgttcccgccctcctccaccgagagta

SEQ ID NO: 560495 - DNA, 494 bp, Homo sapiens; identical to SEQ ID NO: 534994
  misc_feature: HIJSMM301BXEV2.27.78.H01.1.454.light.4.raw

SEQ ID NO: 560496 - DNA, 491 bp, Homo sapiens; identical to SEQ ID NO: 535294
  misc_feature: HIJSMM301EW9PE.16.68.G02.1.454.light.4.raw

SEQ ID NO: 560497 - DNA, 497 bp, Homo sapiens; identical to SEQ ID NO: 535286
  misc_feature: HIJSMM301D4UFC.18.59.F04.1.454.light.4.raw

SEQ ID NO: 560498 - DNA, 521 bp, Homo sapiens; identical to SEQ ID NO: 538715
  misc_feature: HIJSMM301EOKVR.27.23.C01.1.454.light.4.raw

SEQ ID NO: 560499 - DNA, 496 bp, Homo sapiens; identical to SEQ ID NO: 540207
  misc_feature: HIJSMM301BS4I7.40.57.F02.1.454.light.4.raw

SEQ ID NO: 560500 - DNA, 498 bp, Homo sapiens
  misc_feature: HIJSMM301COUB6.16.46.E02.1.454.light.4.raw
tgtactactccacgaccggtgctcgatttagactcatctacagggaaaggggctgtgcctgggctctgctcctcctcaccctcctcactcagggcacaggatcctgggctcagtctgccctgactcagcctccccccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggcccaaccccactgtcactctgttcccaccctcctcgagtagtaca

SEQ ID NO: 560501 - DNA, 498 bp, Homo sapiens
  misc_feature: HIJSMM301A9KMN.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgcccccccgatcaccttcggtccaacggacgacgactggagaattaacgtaactgtggctcgcgaccactctcgtcttctat

SEQ ID NO: 560502 - DNA, 500 bp, Homo sapiens; identical to SEQ ID NO: 535310
  misc_feature: HIJSMM301ERZAV.47.66.F11.1.454.light.4.raw

SEQ ID NO: 560503 - DNA, 498 bp, Homo sapiens
  misc_feature: HIJSMM301CE4DC.4.27.C05.1.454.light.4.raw
agcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggccctcagggatccctgagcgcttctctggatccaactctgggaacacagccactctgaccatcagcgggacccaacttttagatgaggccgactatttctgtcacacgtgggacatgggcactgcgatcttcggcggagggaccaagctgaccgtcctgggtcagcccaaggctcgccccctcggtcactccg

SEQ ID NO: 560504 - DNA, 506 bp, Homo sapiens; identical to SEQ ID NO: 543847
  misc_feature: HIJSMM301CWX66.21.87.H10.1.454.light.4.raw

SEQ ID NO: 560505 - DNA, 487 bp, Homo sapiens
  misc_feature: HIJSMM301AFR9K.48.53.E09.1.454.light.4.raw
agtatacatacacgaccggtgctcgatttagagagagtgtgttgggtttgggggaagagctgctcagttaggacccagagggaaccatggaaaccccagcgcagcttctcttcctcctgctactctggctcccagataccaccggagcacttgtgttgacgcagtctccaggcaccctgtctttgtctccaggggagagagccaccctctcctgcagggccagtcagagtgttagcggcggctccgtagcctggtaccagcagaaacgtggccaggttcccaggctcctcatctatgatgcatccagcagggccactggcatcccagacaggttcagtggcagtgggtctgggacagacttcactctcaccatcagcagactggagcctgaagatttgcagtgtattactgtcagcagtatggtagctcacctcaactcactttcggcggagggaccaaggtggagatcaaacgaactgtggctgca

SEQ ID NO: 560506 - DNA, 512 bp, Homo sapiens
  misc_feature: HIJSMM301BVI9L.15.34.D01.1.454.light.4.raw
tctacgtagccacgaccggtgctcgatttagatcgtctgtgttggggttgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtggggcgtggcatttgggtgttcggcggagggaccaaactgaccgtcctaggtcagcccaaggcctgccccctcggtcactctcg

SEQ ID NO: 560507 - DNA, 502 bp, Homo sapiens; identical to SEQ ID NO: 537816
  misc_feature: HIJSMM301DY1KM.19.78.H01.1.454.light.4.raw

SEQ ID NO: 560508 - DNA, 506 bp, Homo sapiens; identical to SEQ ID NO: 549267
  misc_feature: HIJSMM301B1S5N.3.79.H02.1.454.light.4.raw

SEQ ID NO: 560509 - DNA, 517 bp, Homo sapiens
  misc_feature: HIJSMM301DDVIQ.52.37.D04.1.454.light.4.raw
  modified_base (345)..(345): a, c, t, g, unknown or other
cgcagtacgacacgaccggtgctcgatttagtagcatactgttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtgcttatgactttgtctcctggtaccaacaccaccctggcaaagcccccaaactcatcatttttgaggtcactaagcggccctcaggggtccctgatcgcttctctggntcccgaagtctggcaacacggcctccctgaccgtctctgggctccaggctgaggatgaggctgattactactgcacctcatatgcaggcgacaacaatttgggggttttcggcggagggaccaaggtgaccgtcctacgtcagcccaaggctgccccctcggtcactctgtt

SEQ ID NO: 560510 - DNA, 497 bp, Homo sapiens
  misc_feature: HIJSMM301BCG0X.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacgacgactggagattaaaaggaactgtggctgcaccactctgtcttcatcttccccg

SEQ ID NO: 560511 - DNA, 495 bp, Homo sapiens
  misc_feature: HIJSMM301DB4CC.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatctgtcttctatctttcccg

SEQ ID NO: 560512 - DNA, 493 bp, Homo sapiens
  misc_feature: HIJSMM301A7ACA.13.48.E04.1.454.light.4.raw
tcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtggggtcccatcaaggttcagcggcagtggatctggcacagacttcattctcaccatcagcagcctgcagcctgaagattttgcaacttattactgtctacaagatcacaattatcctgggacgtttcggccgaagggaccgaaggtacggaaagttacaaacgaaactagtggctcg

SEQ ID NO: 560513 - DNA, 505 bp, Homo sapiens
  misc_feature: HIJSMM301B7CIS.48.36.D03.1.454.light.4.raw
agtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccgatcggcctaggcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgaccatctctgggctccaggctgaagatcaggctgattattactgctgttcattttcaagttccttttgtcttcggaactgggaccgaggtcaccgtcctaggtcagcccaaggccaacccactgtca

SEQ ID NO: 560514 - DNA, 476 bp, Homo sapiens; identical to SEQ ID NO: 538026
  misc_feature: HIJSMM301BUM0U.13.76.G10.1.454.light.4.raw

SEQ ID NO: 560515 - DNA, 508 bp, Homo sapiens
  misc_feature: HIJSMM301AYVJV.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctggtcactctgttccca

SEQ ID NO: 560516 - DNA, 489 bp, Homo sapiens
  misc_feature: HIJSMM301CID8X.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggtccaagggaccaaggtggagtattcagacgaa

SEQ ID NO: 560517 - DNA, 476 bp, Homo sapiens
  misc_feature: HIJSMM301EKDWH.49.50.E06.1.454.light.4.raw
agtcgagagacacgaccggtgctcgatttagatctactgacaacacacaagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaactatttaaattggtatcagcagaaaccagggaaagcccctaaactcctgatctacgatgcatccaatttggagacaggggtcccatcaaggttcagtggaagtggatctgggacacattttactttcaccatcagcggcctgcagcctgaagattttgcaacatattactgtcaacagtatgaagatctcccactcactttcggcggagggaccaaggtggagatcagacgaactgtgg

SEQ ID NO: 560518 - DNA, 447 bp, Homo sapiens; identical to SEQ ID NO: 535201
  misc_feature: HIJSMM301EL7WI.18.9.A09.1.454.light.4.raw

SEQ ID NO: 560519 - DNA, 452 bp, Homo sapiens
  misc_feature: HIJSMM301CJ2ME.19.86.H09.1.454.light.4.raw
  modified_base (449)..(449): a, c, t, g, unknown or other
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcgcaaggctgccccctggtcactctgttcccacctcctccacgagngta

SEQ ID NO: 560520 - DNA, 490 bp, Homo sapiens
  misc_feature: HIJSMM301BGLI4.13.5.A05.1.454.light.4.raw
tcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtggagatcaaacgaactagt

SEQ ID NO: 560521 - DNA, 445 bp, Homo sapiens; identical to SEQ ID NO: 550734
  misc_feature: HIJSMM301B7YOY.5.9.A09.1.454.light.4.raw

SEQ ID NO: 560522 - DNA, 506 bp, Homo sapiens
  misc_feature: HIJSMM301A346W.19.10.A10.1.454.light.4.raw
tactctcgtgcacgaccggtgctcgatttagcgtcgatctcagggggagctgctcagttaggacccagagggaaccatggaaaccccagcgcagcttctcttcctcctgctactctggctcccagatagcaccggagtaaattttcttgacgcagtctccaggcaccctgtctttgacccctggggaaagagccaccctctcctgcgagggccgataagagtgttgacagcaccttctttgcctggtaccagcagagacctggccaggctcccaggctcctcgtttatggtgcgtccaccagggccactggcatccccgacaggttcagtggcagtgtgtctgggacagacttcactctcaccatcagcagactggagcctgaagattttgcagtgtattactgtcaacgatatgatgagtcacctccgtggtggacatttggccaggggaccaaggttgaagtacaaacgaaactgtggctgcaccatctgtcttcatcttcccc

SEQ ID NO: 560523 - DNA, 489 bp, Homo sapiens
  misc_feature: HIJSMM301ATXCZ.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggtcggagggaccagggtggagatcagacgaactgtggctgcaccatct

SEQ ID NO: 560524 - DNA, 494 bp, Homo sapiens; identical to SEQ ID NO: 534994
  misc_feature: HIJSMM301EQDDQ.27.78.H01.1.454.light.4.raw

SEQ ID NO: 560525 - DNA, 487 bp, Homo sapiens; identical to SEQ ID NO: 538189
  misc_feature: HIJSMM301AHJJS.3.12.B01.1.454.light.4.raw

SEQ ID NO: 560526 - DNA, 497 bp, Homo sapiens
  misc_feature: HIJSMM301EVSBG.40.65.F10.1.454.light.4.raw
tctagcgactcacgaccggtgctcgatttagctacgctctaaggggagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttcccg

SEQ ID NO: 560527 - DNA, 499 bp, Homo sapiens
  misc_feature: HIJSMM301DLTJF.18.11.A11.1.454.light.4.raw
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctctctcacgttcggcggagggaccaaggtggagatcaaacgactgtggctgcaccatctgtctt

SEQ ID NO: 560528 - DNA, 494 bp, Homo sapiens
  misc_feature: HIJSMM301ALKYB.43.61.F06.1.454.light.4.raw
tgtgagtagtcacgaccggtgctcgatttagctacgctctaagggaaagggggaagagctgctcagttaggacccagagggaaccatggaaaccccagcgcagcttctcttcctcctgctactctggctcccagatgccaccggagcaattgtgttgacgcagtctccaggcaccctgtctttgtctccaggagaaacagccaccctctcctgccgggccagtcagagtgttagagaagactacttagcctggtaccagcaaaaacctggccaggctcccaggctcctcatcaatggtgcatccagtagggccactggcatcccagacaggttcagtggcagtgggtctgcgacagacttcactctcattatcagcagactggagcctgaggactttgcagtgtatttctgtcaacaatatggtagctcaccgtacacttttggccaggggaccaagctagaatcaaacgaactgtggctgcaccatctgtctt

SEQ ID NO: 560529 - DNA, 470 bp, Homo sapiens; identical to SEQ ID NO: 535302
  misc_feature: HIJSMM301DQZGH.13.76.G10.1.454.light.4.raw

SEQ ID NO: 560530 - DNA, 459 bp, Homo sapiens
  misc_feature: HIJSMM301EDVNM.51.78.H01.1.454.light.4.raw
cgatcgtatacacgaccggtgctcgatttagtgtgagtagtttgggtttgggagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaagcccccaaactcatgatttatgatgtcagtgatcggccctcaggggtttcgaatcgcttctctggctccaagtccggcaacacggcctccctgaccatctctggcctccaggccgaggacgaggctgattattactgcagctcatatacaatcaataacaattgggtgttcggcggagggaccaaactgaccgtcctaggtcagcccaaggctgccccctcggtcactctgttcccaccctcctctcgtagcact

SEQ ID NO: 560531 - DNA, 439 bp, Homo sapiens
  misc_feature: HIJSMM301BBPJW.14.76.G10.1.454.light.4.raw
cgtctagtaccacgaccggtgctcgatttagtcactcatacagggtcctgggcccagtctgtgctgactcagccaccctcagcgtctgggccccccggcagagggtctccatctcttgttctggagtcacttccaacatcggaaataatgatgtgagctggtaccagcaggtcccaggaacggcccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatggcaattgggtattcggcggagggaccaagttgaccgtcctaagtcagcccaaggctgccccctcggtcactctgtgccctcctcgtactagacg

SEQ ID NO: 560532 - DNA, 494 bp, Homo sapiens
  misc_feature: HIJSMM301CA06F.52.10.A10.1.454.light.4.raw
cgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctcttacctggcctggtaccaacaaaaacctgcccaggctcccaggctcctcatctatgatgcatccaatcgggccactggcatcccagccaggttcagtggcagtgggtctgggacagacttcactctcaccatcagcaacctagagcctgaagactttgcagtttattactgtcagcagcgtagtaagtggcgcttcggccaagggacacactggaggttaaacgaactgtggctgcaccatctgtcttcatccttcccgccat

SEQ ID NO: 560533 - DNA, 515 bp, Homo sapiens; identical to SEQ ID NO: 560289
  misc_feature: HIJSMM301EZRN0.16.85.H08.1.454.light.4.raw

SEQ ID NO: 560534 - DNA, 487 bp, Homo sapiens; identical to SEQ ID NO: 539157
  misc_feature: HIJSMM301BVTA1.26.37.D04.1.454.light.4.raw

SEQ ID NO: 560535 - DNA, 507 bp, Homo sapiens
  misc_feature: HIJSMM301C7GOB.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccaccagttagcctggtaccaacacaaacctggccaggctcccaggccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccgaaaacttgagatcaaacgaaactgtggctgcaccactctgtcttcatcttcccgccc

SEQ ID NO: 560536 - DNA, 493 bp, Homo sapiens
  misc_feature: HIJSMM301A98Y9.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggccagcagtggtaacattgtgatattcgggcggagggaccaaggtgaccgtctacgtcagcccaaggctgccccctcggtcact

SEQ ID NO: 560537 - DNA, 470 bp, Homo sapiens; identical to SEQ ID NO: 535302
  misc_feature: HIJSMM301DHOSK.13.76.G10.1.454.light.4.raw

SEQ ID NO: 560538 - DNA, 352 bp, Homo sapiens
  misc_feature: HIJSMM301D10TJ.4.67.G01.1.454.light.4.raw
  modified_base (334)..(334): a, c, t, g, unknown or other
agcactgtagcacgaccggtgctcgatttagagtatacatattggttactatgactttgtctcgtggtaccaacaacacccaggcaaagcccccaaactcataatttatggtgtcactaagcggccctcaggggtccctgatcgcttctctggctccaagtctggcaacatggcctccctgaccatctctgggctccaggctgaggatgaggctgattactactgctgctcctttgcaggcgcctctgtctcaggcagctatgtcttcggaactgggaccgaagtgaccgtcctgggtcagcccaaggccaaccccactgtcactctgttcccnccctcctcctacagtgct

SEQ ID NO: 560539 - DNA, 501 bp, Homo sapiens
  misc_feature: HIJSMM301AGB7T.17.53.E09.1.454.light.4.raw
  modified_base (433)..(433): a, c, t, g, unknown or other
  modified_base (462)..(462): a, c, t, g, unknown or other
cgtagactagcacgaccggtgctcgatttagagagagtgtgttgggtttggggagctgctcagttaggacccagagggaaccatggaaaccccagcgcagcttctcttcctcctgctactctggctcccagatgtcaccggagaagttgtgttgacgcagtctccagccaccctgtctttgtctccaggggaaaagccaccctctcctgctgggccagccagtatgtcagcagtgataatttagcctggtatcagcaaaaacatggccaggctcccaggctcctcatctttggtgcatccagcaggatcactggcgtccctcgacaggttcagaggcagggggtcgtgggacagacttcactctcaccatcaacagactggagcctgaagattttgcaatttattattgtcagcagtatggttcctcaccatntttcggtcggagggaccgaggtgggagangtaatcgaactgttggcgtgcaccactcttgtctttcta

SEQ ID NO: 560540 - DNA, 511 bp, Homo sapiens; identical to SEQ ID NO: 537464
  misc_feature: HIJSMM301C2HTV.7.34.D01.1.454.light.4.raw

SEQ ID NO: 560541 - DNA, 504 bp, Homo sapiens
  misc_feature: HIJSMM301BSGR7.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactgtgctgcaccatctgtcttcatcttcccgcc

SEQ ID NO: 560542 - DNA, 504 bp, Homo sapiens; identical to SEQ ID NO: 557936
  misc_feature: HIJSMM301BEXMM.19.78.H01.1.454.light.4.raw

SEQ ID NO: 560543 - DNA, 503 bp, Homo sapiens; identical to SEQ ID NO: 538973
  misc_feature: HIJSMM301AXJYX.5.86.H09.1.454.light.4.raw

SEQ ID NO: 560544 - DNA, 485 bp, Homo sapiens; identical to SEQ ID NO: 535606
  misc_feature: HIJSMM301EJGOP.47.46.E02.1.454.light.4.raw

SEQ ID NO: 560545 - DNA, 490 bp, Homo sapiens
  misc_feature: HIJSMM301AJPAL.16.68.G02.1.454.light.4.raw
  modified_base (451)..(451): a, c, t, g, unknown or other
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtgagggaccaaaggnggaggtcaaagaactgtggctgcaccatctgtcttcatt

SEQ ID NO: 560546 - DNA, 490 bp, Homo sapiens; identical to SEQ ID NO: 536481
  misc_feature: HIJSMM301B0HDH.13.46.E02.1.454.light.4.raw

SEQ ID NO: 560547 - DNA, 486 bp, Homo sapiens
  misc_feature: HIJSMM301B1HMP.4.2.A02.1.454.light.4.raw
agcactgtagcacgaccggtgctcgatttagactcatctacaggggagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtggggtcccatcaaggttcagtggcagtggatctgggacagatttcactctcaccatcagtagtctacaacctgaagattttgcaacttactactgtcaacagagttacgatacccctccgctcactttcgcggagggaccaaggtggagatcaaacgaaactgtggctgcaccaatctgtcttcta

SEQ ID NO: 560548 - DNA, 504 bp, Homo sapiens; identical to SEQ ID NO: 537401
  misc_feature: HIJSMM301E2ATP.51.23.C01.1.454.light.4.raw

SEQ ID NO: 560549 - DNA, 509 bp, Homo sapiens; identical to SEQ ID NO: 544573
  misc_feature: HIJSMM301B52D4.10.88.H11.1.454.light.4.raw

SEQ ID NO: 560550 - DNA, 502 bp, Homo sapiens
  misc_feature: HIJSMM301CTFR4.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcggaggaccaagctgaccgtcctgggtcagcccaaggctgccccctggtcta

SEQ ID NO: 560551 - DNA, 497 bp, Homo sapiens
  misc_feature: HIJSMM301C3J51.48.83.H06.1.454.light.4.raw
agtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcagggggacccaggccttggatgaggctgactatcactgtcaggcgtgggacagcaacactgcgattttcggcgggggaccaggctgaccgtcggcggtcagccaaggctgcccctcggtcactctgttcccg

SEQ ID NO: 560552 - DNA, 507 bp, Homo sapiens
  misc_feature: HIJSMM301DHIRC.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaaggtaggaaagtcaaacgaactagtggctgcaccatctgtcttctatcttccccg

SEQ ID NO: 560553 - DNA, 508 bp, Homo sapiens
  misc_feature: HIJSMM301C7T65.11.57.F02.1.454.light.4.raw
cgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaaggtggaagtcaagcgaactgtggctgcaccatctgtcttctatcttcccgcc

SEQ ID NO: 560554 - DNA, 488 bp, Homo sapiens
  misc_feature: HIJSMM301B0NNT.51.30.C08.1.454.light.4.raw
cgatcgtatacacgaccggtgctcgatttagtctgacgtcaaagggaaagggggaatcagtcccactcaggacacagcatggacatgagggtccccgctcagctcctggggctcctgctgctctggttcccaggtcccaggtgtgacatccagatgacccagtctccaccctccctgtctgcttctgtacgagacagagtcaccatcacttgccggacaagtcagggcactagaagttctttaggctcctttcagcagagaccagggaaagcccctacgcgccttaactatgttacattcagtttgcaaagtggcgtcccatcaaggtccagcggcattggatctggggcagaattcactctcacattcagcagcctgcagcctgaagatttttcaacttataagtgtctacatcataattcttggagagatcacacgttggaactgtggctgcaccatctgtcttcatcttcccgccatctgatcgt

SEQ ID NO: 560555 - DNA, 479 bp, Homo sapiens
  misc_feature: HIJSMM301DYB2P.21.25.C03.1.454.light.4.raw
  modified_base (445)..(445): a, c, t, g, unknown or other
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacanaccctgcgtggttttggctgttcggcggcgggcc

SEQ ID NO: 560556 - DNA, 518 bp, Homo sapiens
  misc_feature: HIJSMM301AX5SG.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccggtcttaaagtcagcccaaggctgccccctccggtcactctcgttcccacccctcct

SEQ ID NO: 560557 - DNA, 487 bp, Homo sapiens; identical to SEQ ID NO: 539157
  misc_feature: HIJSMM301D74M4.26.37.D04.1.454.light.4.raw

SEQ ID NO: 560558 - DNA, 493 bp, Homo sapiens
  misc_feature: HIJSMM301A97SZ.15.59.F04.1.454.light.4.raw
tctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaagctgccctcaccatcacgggggcccaggcagatgatgaatctgtttattattgtgtcctatatatgggtgctggcatttcggtcttcggcggagggaccaagctgaccgtcctaggtcagcccaaggctgccccctcggtcactctgttcccaccctcctcgctacgtaga

SEQ ID NO: 560559 - DNA, 492 bp, Homo sapiens; identical to SEQ ID NO: 535939
  misc_feature: HIJSMM301BMSWP.13.5.A05.1.454.light.4.raw

SEQ ID NO: 560560 - DNA, 498 bp, Homo sapiens; identical to SEQ ID NO: 538749
  misc_feature: HIJSMM301CW3V1.43.34.D01.1.454.light.4.raw

SEQ ID NO: 560561 - DNA, 488 bp, Homo sapiens; identical to SEQ ID NO: 535081
  misc_feature: HIJSMM301C10H6.26.23.C01.1.454.light.4.raw

SEQ ID NO: 560562 - DNA, 516 bp, Homo sapiens
  misc_feature: HIJSMM301CMXJE.7.87.H10.1.454.light.4.raw
cgtgtctctacacgaccggtgctcgatttagcagtactgcgttgggtttggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgtccgaacggaccgaacggtaggaagtacgaaacgaactagtggcgtgcaccactctcgtcttctactcttcccgtccact

SEQ ID NO: 560563 - DNA, 499 bp, Homo sapiens
  misc_feature: HIJSMM301EBCL1.4.37.D04.1.454.light.4.raw
agcactgtagcacgaccggtgctcgatttagtagcatactgttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcacccaggcaaagcccccaaactcataatttatgatgtcagtaatcggccctcaggggtttctaatcgcttctctggttacaagtctggcaacacggcctccctgaccatctctgggctccaggctgaggacgaggctgatttattactgcagctcatatacaagcagcagcactggggtcttcggaactgggaccaaggtcaccgtcgtcccacgtcagcccaa

SEQ ID NO: 560564 - DNA, 469 bp, Homo sapiens
  misc_feature: HIJSMM301ENTUU.5.15.B04.1.454.light.4.raw
atcagacacgcacgaccggtgctcgatttagacagtatatatccggcgggggcaggagtcagactcagtcaggacacagcatggacatgagggtcccgctcagctcctggggctcctgctgctctggctcccaggtgccaaatgtgacatccagatgacccagtctccttccaccctgtctgcatctataggagacagagtcaccatcacttgtcgggccagtcagagtattagtaactggttggcctggtatcagcagaaaccaggcaaagccccaaagctccttatctctgatgcctccactttgcacggtggggtcccaccaacgttcagcggcagtggatctgggacagaattcactctcaccatcagcagcctgcagcctgatgatgctgcaacttatactgtcaacaatataacagttattggacgttcggccaagggaccaaggtgggaaatacaaacgaaa

SEQ ID NO: 560565 - DNA, 472 bp, Homo sapiens; identical to SEQ ID NO: 536302
  misc_feature: HIJSMM301DL3EF.18.76.G10.1.454.light.4.raw

SEQ ID NO: 560566 - DNA, 497 bp, Homo sapiens; identical to SEQ ID NO: 535286
  misc_feature: HIJSMM301BHVZI.18.59.F04.1.454.light.4.raw

SEQ ID NO: 560567 - DNA, 498 bp, Homo sapiens
  misc_feature: HIJSMM301CMYHL.3.31.C09.1.454.light.4.raw
agacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcaactacttagcctggtaccaacagaaacctggccaggctcccaggctcctcatctatgatgcatccaacagggccactggcatcccagccaggttcagtggcagtgggtctgggacagacttcactctcaccatcagcagcctagagcccgaagattttgcagtttattactgtcagcagcgtagcaactggcctctcactttcggcggagggaccaaggtggagatcaaacgaactgtggctgcaccatctgtcttcta

SEQ ID NO: 560568 - DNA, 501 bp, Homo sapiens; identical to SEQ ID NO: 536142
  misc_feature: HIJSMM301C3WLX.15.1.A01.1.454.light.4.raw

SEQ ID NO: 560569 - DNA, 498 bp, Homo sapiens
  misc_feature: HIJSMM301C4NIR.3.31.C09.1.454.light.4.raw
  modified_base (459)..(459): a, c, t, g, unknown or other
  modified_base (485)..(485): a, c, t, g, unknown or other
agacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcaactacttagcctggtacaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggctctcacttcgtcggagggaccaagtaggnggaatcaaagaaacctagtggctgcnccaatctgtcttt

SEQ ID NO: 560570 - DNA, 489 bp, Homo sapiens; identical to SEQ ID NO: 543840
  misc_feature: HIJSMM301CY50X.12.88.H11.1.454.light.4.raw

SEQ ID NO: 560571 - DNA, 506 bp, Homo sapiens; identical to SEQ ID NO: 537290
  misc_feature: HIJSMM301C1P91.13.11.A11.1.454.light.4.raw

SEQ ID NO: 560572 - DNA, 487 bp, Homo sapiens
  misc_feature: HIJSMM301ARSE3.21.65.F10.1.454.light.4.raw
tcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaaacctggccagcctcccaggctcctcatctatggtgcatccgccagggccactggaatcccagccaggttcagtggcactgggtctgggacagagttcactctcaccatcagcagcctgcagtctgaagattttgaagtttattctgtctgcagtacaatcagtggcctcggacgttcggccaagggaccaaggtggaaatcaaacgaactgtggctgcaccatctgtcttc

SEQ ID NO: 560573 - DNA, 463 bp, Homo sapiens; identical to SEQ ID NO: 535062
  misc_feature: HIJSMM301AFFC4.11.73.G07.1.454.light.4.raw

SEQ ID NO: 560574 - DNA, 489 bp, Homo sapiens; identical to SEQ ID NO: 546040
  misc_feature: HIJSMM301AK7HM.11.12.B01.1.454.light.4.raw

SEQ ID NO: 560575 - DNA, 518 bp, Homo sapiens; identical to SEQ ID NO: 539372
  misc_feature: HIJSMM301C419K.7.86.H09.1.454.light.4.raw

SEQ ID NO: 560576 - DNA, 482 bp, Homo sapiens
  misc_feature: HIJSMM301CT40U.7.83.H06.1.454.light.4.raw
cgtgtctctacacgaccggtgctcgatttagatcacgtgcgtcgcggggctccaaacagagcttcagcaagcatagtgggaatctgcaccatgcccggggctctgctcctcctgaccctcctcactcactctgcagtgtcagtggtccaggcagggctgactcagccgccctcggtgtccaagggcttggggcagaccgccacactcacctgcactgggaacagcaacaatgttggcgaccaaggagcagcttggctgcagcagcaccagggccaccctcccaaactcctatcctacaggaataacaaccggccctcagggatctcggagagattctctgcatccaggtcaggatacacagccctcctgaccattactggactccagcctgaggacgaggctgactattactgctcagcatgggacagcagcctccggtggtgtggtgagtcggcgggagggaccagggctcggaccgtcct

SEQ ID NO: 560577 - DNA, 495 bp, Homo sapiens; identical to SEQ ID NO: 535596
  misc_feature: HIJSMM301AJ57T.10.79.H02.1.454.light.4.raw

SEQ ID NO: 560578 - DNA, 518 bp, Homo sapiens; identical to SEQ ID NO: 535407
  misc_feature: HIJSMM301BYTIY.22.30.C08.1.454.light.4.raw

SEQ ID NO: 560579 - DNA, 494 bp, Homo sapiens; identical to SEQ ID NO: 543247
  misc_feature: HIJSMM301C4QCS.22.57.F02.1.454.light.4.raw

SEQ ID NO: 560580 - DNA, 489 bp, Homo sapiens; identical to SEQ ID NO: 535139
  misc_feature: HIJSMM301ENS86.14.55.E11.1.454.light.4.raw

SEQ ID NO: 560581 - DNA, 486 bp, Homo sapiens; identical to SEQ ID NO: 535385
  misc_feature: HIJSMM301D5P82.19.71.G05.1.454.light.4.raw

SEQ ID NO: 560582 - DNA, 505 bp, Homo sapiens
  misc_feature: HIJSMM301CHHH8.4.10.A10.1.454.light.4.raw
agcactgtagcacgaccggtgctcgatttagcgtcgatctcagggggggtagagaagacaggactcaggacaatctccagcatggccagcttccctctcctcctcaccctcctcactcactgtgcagggtcctgggcccactctgtgctgactcagccaccctcagcgtctgggacccccgggcagagggtcaccatctcttgttctggaagcacctccaacatcggaagtaatcctgtaaactggttccagcaactcccaggaagggcccccaaagtcctcatctatggtcagaatcagcgtccctcaggggtccctgaccgattctctggctccaagtctgacacctcagcctccctggccatcagtgggctccagtctgaggatgaggctgattattactgtgcaacatgggatgacatcctacgtggtgcggtgttcggcggagggaccaagttgaccgtctgggtcagcccaaggctgccccctcggtcactctgttccc

SEQ ID NO: 560583 - DNA, 519 bp, Homo sapiens
  misc_feature: HIJSMM301DXUQE.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgcccctcggtcactctgtcccaccct

SEQ ID NO: 560584 - DNA, 495 bp, Homo sapiens; identical to SEQ ID NO: 549639
  misc_feature: HIJSMM301BTVOS.10.49.E05.1.454.light.4.raw

SEQ ID NO: 560585 - DNA, 495 bp, Homo sapiens; identical to SEQ ID NO: 536359
  misc_feature: HIJSMM301CXQXW.48.4.A04.1.454.light.4.raw

SEQ ID NO: 560586 - DNA, 492 bp, Homo sapiens
  misc_feature: HIJSMM301EVHGD.43.60.F05.1.454.light.4.raw
tgtgagtagtcacgaccggtgctcgatttagtacgtcatcagggaaaggggggagtcagacccactcaggacacagcatggacatgagggtccccgctcagctcctggggctcctgctgctctggctcccaggtgccagatgtgccatccagatgacccagtctccgtcctccctgtcctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcggtccacgggaccgacggtcggagtgtctaagcgaacgtgtggcgtggcaccat

SEQ ID NO: 560587 - DNA, 384 bp, Homo sapiens; identical to SEQ ID NO: 539298
  misc_feature: HIJSMM301BQI5L.41.26.C04.1.454.light.4.raw

SEQ ID NO: 560588 - DNA, 453 bp, Homo sapiens
  misc_feature: HIJSMM301ESORX.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggtggagggaccaagctgaccgtcctaagtcagcccaaggctgccccctcggtcactctgttcccgccctcctccacgaggta

SEQ ID NO: 560589 - DNA, 503 bp, Homo sapiens
  misc_feature: HIJSMM301BYO0V.18.23.C01.1.454.light.4.raw
tacgagtatgcacgaccggtgctcgatttagtacacgtgattagggattgggggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaagcccctaagctgcagatgattggtccgtccagtttccaagatggggccccatcgagattccgcgtcagtggatctgggacagatttcactctcaccatcagcagcctgcagcctgaagattttgcaacttactattgtcagcaggcgcacaatttcccgctcactttcggcggagggaccaaggtggaggatcaaacgaactgtggctgcaccatctgtcttcatcttccccg

SEQ ID NO: 560590 - DNA, 494 bp, Homo sapiens; identical to SEQ ID NO: 534992
  misc_feature: HIJSMM301B4LIZ.9.1.A01.1.454.light.4.raw

SEQ ID NO: 560591 - DNA, 510 bp, Homo sapiens
  misc_feature: HIJSMM301ALO8G.49.35.D02.1.454.light.4.raw
agtcgagagacacgaccggtgctcgatttagcacacgatagttgggtttgggggtgggtccaggaggcagaactctgggtgtctcaccatggcctggatccctctacttctccccctcctcactctctgcacaggctctgaggcctcctatgagttgatccagccaccctcggtgtcagtgtccccaggacagacggccaggattctttgctctggagatgcgttggcaaaacagtttgcttattggttccagcagaagccaggccaagcccctgtggtggtgatttataaaggctttcagaggccctcagggatccctgagcgattctctgggtccagctcagggacaacagccatgttgaccatcagtggagtccaggcagaagacgaggctgactattattgtcaatcagcagacaacactgttgtttctgtgtttttcggtcggcgggaccaggctgaccgtcctgggtcagcccaaggctgccccctcggtcactctgttcccta

SEQ ID NO: 560592 - DNA, 493 bp, Homo sapiens
  misc_feature: HIJSMM301DV6I3.12.38.D05.1.454.light.4.raw
atacgacgtacacgaccggtgctcgatttagtatctgatagttgggtttgggggaactgctcagttaggacccagacggaaccatggaagccccagcgcagcttctcttcctcctgctactctggctcccagattcctctggagaagttgtgatgacgcagtctccagccaccctgtctgcgtctccaggggaaagagtcaccctctcatgcagggccagtgagattgttaccaccaacttagcctggtaccaacagaaacctggccagcctcccaggctcctcatttatggtgcatccacaagggccgctggtgtcccagccaggttcagtggcagtggatctgcgacagagttcactctcaccgtcagcagcctgcagtctgaagattttgcagtttattactgtcagcagtatgagaagtggttcaagactttcggcggagggaccaaggtggagatcaaacgaactgtggctgcaccatctgtcttcat

SEQ ID NO: 560593 - DNA, 497 bp, Homo sapiens; identical to SEQ ID NO: 536371
  misc_feature: HIJSMM301BKCRA.16.78.H01.1.454.light.4.raw

SEQ ID NO: 560594 - DNA, 476 bp, Homo sapiens; identical to SEQ ID NO: 538611
  misc_feature: HIJSMM301COZUO.7.81.H04.1.454.light.4.raw

SEQ ID NO: 560595 - DNA, 489 bp, Homo sapiens; identical to SEQ ID NO: 535139
  misc_feature: HIJSMM301C2UDG.14.55.E11.1.454.light.4.raw

SEQ ID NO: 560596 - DNA, 482 bp, Homo sapiens
  misc_feature: HIJSMM301EZBMX.41.68.G02.1.454.light.4.raw
tctatactatcacgaccggtgctcgatttagtcgatagtgaagggaaagggggagtcagtcccaaccaggacacagcatggacatgagggtccctgctcagctcctggggctcctgctgctctggctctcaggtgccagatgtgacatccagatgacccagtctccaacctccctgtctgcatctgtaggagacagagtcaccatcacttgccaggccagtcaggacattagcaactatttaaattggtatcagcagaaaccagggaaagcccctaagctcctgatctacgatgcacccaatttggaatcaggggtcccatcaaggttcagtggaagtggatctgggacagattttactttcaccatcaccagcctgcagcctgaagatattgcaacatattactgtcaacagtatgataatctccctccactttcggcggagggaccaaggtggagatcaacgaactagtggctgcaccat

SEQ ID NO: 560597 - DNA, 501 bp, Homo sapiens
  misc_feature: HIJSMM301DKHJ6.48.87.H10.1.454.light.4.raw
agtatacatacacgaccggtgctcgatttagcagtactgcgttgggtttggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcgttatgaccttgtctcctggtaccaacaacacccaggcaaagcccccaaactcttgatttatgagatcactaagcggccctcaggcgtttctaatcgcttctctggctccaagtctggcaacacggcctccctgacaatctctgggctccaggctgaggacgaggctgattattattgctgctcatatgcaggtggtactacttgggtgttcggcagagggaccaagctgaccgtcctaggtcagcccaaggctgccccccg

SEQ ID NO: 560598 - DNA, 493 bp, Homo sapiens; identical to SEQ ID NO: 557331
  misc_feature: HIJSMM301ENZDM.19.71.G05.1.454.light.4.raw

SEQ ID NO: 560599 - DNA, 487 bp, Homo sapiens; identical to SEQ ID NO: 554782
  misc_feature: HIJSMM301EZZWR.46.35.D02.1.454.light.4.raw

SEQ ID NO: 560600 - DNA, 494 bp, Homo sapiens
  misc_feature: HIJSMM301DUV8J.27.78.H01.1.454.light.4.raw
agcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttggcccaagggacacgactggagattaaacgaactgtggctgcaccatctgtt

SEQ ID NO: 560601 - DNA, 505 bp, Homo sapiens; identical to SEQ ID NO: 535503
  misc_feature: HIJSMM301D6S5H.8.28.C06.1.454.light.4.raw

SEQ ID NO: 560602 - DNA, 497 bp, Homo sapiens; identical to SEQ ID NO: 535286
  misc_feature: HIJSMM301EY7HE.18.59.F04.1.454.light.4.raw

SEQ ID NO: 560603 - DNA, 486 bp, Homo sapiens
  misc_feature: HIJSMM301E0D7W.4.19.B08.1.454.light.4.raw
agcactgtagcacgaccggtgctcgatttagtgagtcagtaaggggggagtcagactcagtcaggacacagcatggacatgagggtccccgctcagctcctggggctcctgctgctctggctcccaggagccgattgtggacagtccaaggttgacccagtctccctccaccctgtctgcatctataggagacagagtcaccatcacttgtcgggccagtcagaatatcaataggtggttggcctggtatctgcagagaccagggagagccccaaaactccttatctatgatgcctctactttgcacactggggtcccaccaacgttcagcggcagtggatccgggacagaattcactctcaccatcagcagcctgcagcctgatgatcttggaacttattactgccaacagtataatagttattggacgttcggccaggggaccaaggtggaattcaaacgaactgtggctgcaccatctgtctt

SEQ ID NO: 560604 - DNA, 493 bp, Homo sapiens; identical to SEQ ID NO: 540903
  misc_feature: HIJSMM301EBY80.10.20.B09.1.454.light.4.raw

SEQ ID NO: 560605 - DNA, 489 bp, Homo sapiens
  misc_feature: HIJSMM301CKQZY.14.55.E11.1.454.light.4.raw
  modified_base (455)..(455): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaggcggagntcagacgaactgtggctgcaccatctgtcttcta

SEQ ID NO: 560606 - DNA, 503 bp, Homo sapiens
  misc_feature: HIJSMM301ERA1U.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggccagcagtggtaacattttgatattcggcggagggaccaaggtgaccgtcctacgtcagcccaaggctgccccctcggtcactctgttccccg

SEQ ID NO: 560607 - DNA, 486 bp, Homo sapiens; identical to SEQ ID NO: 535917
  misc_feature: HIJSMM301CZGBL.3.10.A10.1.454.light.4.raw

SEQ ID NO: 560608 - DNA, 509 bp, Homo sapiens
  misc_feature: HIJSMM301DWMQA.11.57.F02.1.454.light.4.raw
cgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccgaagggaccaaggtggaagtcaagcgaactgtggctgcaccatctgtcttcatccttcccgcc

SEQ ID NO: 560609 - DNA, 489 bp, Homo sapiens; identical to SEQ ID NO: 548452
  misc_feature: HIJSMM301C1B1A.26.37.D04.1.454.light.4.raw

SEQ ID NO: 560610 - DNA, 493 bp, Homo sapiens
  misc_feature: HIJSMM301CJCIO.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccagggaccaagctggagatcaacgaactgtggctgcacatctgt

SEQ ID NO: 560611 - DNA, 495 bp, Homo sapiens
  misc_feature: HIJSMM301CMCXX.3.36.D03.1.454.light.4.raw
agacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccaggggagagagccaccctctcctgcggggccagtcagagtgttcccagcaactatatagcctggtaccagcacaaagttggcctggcgcccaggctcctcatctatgatacattcaccagggccactggcatcccggacaggttcagaggcaggtgggtatgggacagacttcactctcaccatcagcagactggagcctggagattttgctagtttattactgtcagcagtatggtacttcacaaccttcggccaggggacacgactggagattaagcgaactgtggctgcaccatctgtctt

SEQ ID NO: 560612 - DNA, 501 bp, Homo sapiens
  misc_feature: HIJSMM301DYL3I.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtctaggtcagcccaaggccaacccc

SEQ ID NO: 560613 - DNA, 493 bp, Homo sapiens; identical to SEQ ID NO: 535614
  misc_feature: HIJSMM301CL113.9.1.A01.1.454.light.4.raw

SEQ ID NO: 560614 - DNA, 510 bp, Homo sapiens
  misc_feature: HIJSMM301EE571.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaacggtaggaaagtacaaacgtaaactgtggtctgcaccaatctgtcttcatcttccccg

SEQ ID NO: 560615 - DNA, 498 bp, Homo sapiens; identical to SEQ ID NO: 536879
  misc_feature: HIJSMM301CS29P.22.14.B03.1.454.light.4.raw

SEQ ID NO: 560616 - DNA, 510 bp, Homo sapiens; identical to SEQ ID NO: 535376
  misc_feature: HIJSMM301BJLSE.17.33.C11.1.454.light.4.raw

SEQ ID NO: 560617 - DNA, 434 bp, Homo sapiens; identical to SEQ ID NO: 535153
  misc_feature: HIJSMM301DG2QR.18.5.A05.1.454.light.4.raw

SEQ ID NO: 560618 - DNA, 517 bp, Homo sapiens
  misc_feature: HIJSMM301EJ6Z6.49.35.D02.1.454.light.4.raw
agtcgagagacacgaccggtgctcgatttagcacacgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaatacccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaaacataaaacacttgggtgttcggcggcgggaccaaaactgaccgtcctacgtcagcccaaggctgccccctcggtcactctcg

SEQ ID NO: 560619 - DNA, 509 bp, Homo sapiens; identical to SEQ ID NO: 553073
  misc_feature: HIJSMM301BF6CE.16.1.A01.1.454.light.4.raw

SEQ ID NO: 560620 - DNA, 383 bp, Homo sapiens; identical to SEQ ID NO: 447524
  misc_feature: HIJSMM301DUMK6.41.26.C04.1.454.light.4.raw

SEQ ID NO: 560621 - DNA, 481 bp, Homo sapiens
  misc_feature: HIJSMM301AJ0A8.41.34.D01.1.454.light.4.raw
tctatactatcacgaccggtgctcgatttagatcgtctgtgttgggtttggggagtcagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaccagggaaagcccctaaattcctgatctatcaggcatctaatttggaaagtggggtcccatcaaggtttagcggcagtggatctgggacagaattcactctcacgatcagcggcctgcagcctgatgatgtcgcaacttattactgccaacactatgatagttacccgctcactttcggcggagggaccaaggtggaggtcaagcgaactgtggctgcacc

SEQ ID NO: 560622 - DNA, 484 bp, Homo sapiens; identical to SEQ ID NO: 535400
  misc_feature: HIJSMM301BXILT.46.26.C04.1.454.light.4.raw

SEQ ID NO: 560623 - DNA, 494 bp, Homo sapiens; identical to SEQ ID NO: 534994
  misc_feature: HIJSMM301DW000.27.78.H01.1.454.light.4.raw

SEQ ID NO: 560624 - DNA, 434 bp, Homo sapiens; identical to SEQ ID NO: 535153
  misc_feature: HIJSMM301DPDMT.18.5.A05.1.454.light.4.raw

SEQ ID NO: 560625 - DNA, 514 bp, Homo sapiens
  misc_feature: HIJSMM301DKE2L.5.58.F03.1.454.light.4.raw
  modified_base (509)..(509): a, c, t, g, unknown or other
atcagacacgcacgaccggtgctcgatttagtctgatcgagaagggaaagggggggtcgacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcacacttttatgttcgggactgggaccaaggtcaccgtcctaggtcagcccaaggccaaccccactgtcactnttccg

SEQ ID NO: 560626 - DNA, 497 bp, Homo sapiens
  misc_feature: HIJSMM301AH73B.22.14.B03.1.454.light.4.raw
  modified_base (403)..(403): a, c, t, g, unknown or other
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagntgtggcagtttattattgtcagcaaatattatattcctcctcagaccgttggccaagggaccaaggtggaaatcaaacgaactgtggctgcacc

SEQ ID NO: 560627 - DNA, 505 bp, Homo sapiens
  misc_feature: HIJSMM301CDYOG.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaaatagggaccaaggtcaccgtcctaggtcagcccaaggccaacccacctcgtca

SEQ ID NO: 560628 - DNA, 488 bp, Homo sapiens; identical to SEQ ID NO: 539884
  misc_feature: HIJSMM301ETBL7.7.85.H08.1.454.light.4.raw

SEQ ID NO: 560629 - DNA, 508 bp, Homo sapiens; identical to SEQ ID NO: 550253
  misc_feature: HIJSMM301DSZSO.9.55.E11.1.454.light.4.raw

SEQ ID NO: 560630 - DNA, 505 bp, Homo sapiens; identical to SEQ ID NO: 543540
  misc_feature: HIJSMM301EAZGB.9.12.B01.1.454.light.4.raw

SEQ ID NO: 560631 - DNA, 509 bp, Homo sapiens
  misc_feature: HIJSMM301DDQKN.17.41.D08.1.454.light.4.raw
cgtagactagcacgaccggtgctcgatttagtcacgcgagaaagggaaaggggagagctgctcagttaggacccagagggaaccatggaaaccccagcgcagcttctcttcctcctgctactctggctcccagataccaccggagaaattgtgttgacgcagtctccaggcaccctgtccttgtctccaggggaaacagccaccctctcctgtagggccagtcagagtgtttttaaaaactatttagcctggtaccaacagaagcctggccaggctcccaggctcctcatctatggtgcatccaccagggccactggcatcccagacaggttcagtggcggtgggtctgggacagaattcactctcaccatcaccagtctggagcctgaagattttgctctgtatcactgtcagcaatatggtggtacacccctcactttcggcggaggggccaaggtggagatcaagcgaactgtggctgcaccatctgtcttcatctttcccgccat

SEQ ID NO: 560632 - DNA, 511 bp, Homo sapiens
  misc_feature: HIJSMM301BKKPQ.14.85.H08.1.454.light.4.raw
cgtctagtaccacgaccggtgctcgatttagtatcactcagtcgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatatcctgcactggaaccagcagtgacgttggtgcttataactttgtctcctggtaccaacagcacccaggcaaagcccccaaactcatgatttatgacgtcaataagcggccctcgggggtccctgatcgcttctctggctccaagtctggcaacacggcctccctgaccgtctctgggctccaggctgacgatgaggctgattattactgcagctcacatgcagtcagtaacaatttcggggttttcggcggagggaccaagctgaccgtcctaagtcagcccaaggctgccccctcggtcactctcg

SEQ ID NO: 560633 - DNA, 507 bp, Homo sapiens; identical to SEQ ID NO: 539817
  misc_feature: HIJSMM301CI2SF.5.24.C02.1.454.light.4.raw

SEQ ID NO: 560634 - DNA, 506 bp, Homo sapiens
  misc_feature: HIJSMM301D13TY.40.16.B05.1.454.light.4.raw
tctagcgactcacgaccggtgctcgatttagagctcacgtaagggggggtctcaggaggcagcactctcgggacgtctccaccatggcctgggctctgctcctcctcagcctcctcactcagggcacaggatcctggactcagtctgccctgactcagcctcgctcagtgtccgggtctcctggacagtcagtcaccctctcctgcactggaaccagcagtaatgttggtggttataactttgtctcctggtaccaacaccacccaggcaaagcccccaaattcttgatttatgatgtcaataagcggccctcaggggtccctgatcgcttctctggctccaagtctggcaacacggcctccctgacctatctctgggctccaggctgaggatgaggctgattattactgctgctcatttgcaggtagtttttgggtgttcggcggagggaccaagctgaccgtcctaggtcagcccaaggctgccccctggtcactctgttcccg

SEQ ID NO: 560635 - DNA, 505 bp, Homo sapiens; identical to SEQ ID NO: 535503
  misc_feature: HIJSMM301AT4KX.8.28.C06.1.454.light.4.raw

SEQ ID NO: 560636 - DNA, 514 bp, Homo sapiens
  misc_feature: HIJSMM301C2D2P.5.27.C05.1.454.light.4.raw
atcagacacgcacgaccggtgctcgatttagacgcgatcgaagggtttggggagtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagccaaggccaacccactgtcactctgttcccaccctcct

SEQ ID NO: 560637 - DNA, 460 bp, Homo sapiens; identical to SEQ ID NO: 536053
  misc_feature: HIJSMM301CMYRZ.22.28.C06.1.454.light.4.raw

SEQ ID NO: 560638 - DNA, 508 bp, Homo sapiens; identical to SEQ ID NO: 543419
  misc_feature: HIJSMM301DEMHB.4.10.A10.1.454.light.4.raw

SEQ ID NO: 560639 - DNA, 524 bp, Homo sapiens
  misc_feature: HIJSMM301B7AJI.5.27.C05.1.454.light.4.raw
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagccaaggccaaccccacctcgtcactctcgttccctaccctccctccgtcgtc

SEQ ID NO: 560640 - DNA, 497 bp, Homo sapiens
  misc_feature: HIJSMM301B6H3Y.22.9.A09.1.454.light.4.raw
acatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcattccagccaggttcagtggcagtgggtctggaagagacttcactctcaccatcaacagcctagagcctgacgattctgcagtttattactgtcagcagcgtaccaagtggcctccgacttttggccagggggccaagctggagatcagacgaactgtggctgcaccatctgtcttcatcttccccg

SEQ ID NO: 560641 - DNA, 500 bp, Homo sapiens
  misc_feature: HIJSMM301B6TC0.40.42.D09.1.454.light.4.raw
tctagcgactcacgaccggtgctcgatttagacacatacgcagggaaagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagaagcattgccaaaaaatatgcttattggtaccaacagaagtcaggccaggcccctgtgctggtcatctatgaggacaacaaacgaccctccgagatccctgagagattctctggctccagctcagggacaatggccaccttggctctcagtggggcccaggtggaggatgaagctgactactactgttactcagtggacagcagtggaaaatcaatggggtattcggcggagggaccaagctgaccgtcctaggtcagcccaaggctgccccctcggtca

SEQ ID NO: 560642 - DNA, 501 bp, Homo sapiens; identical to SEQ ID NO: 538461
  misc_feature: HIJSMM301AY11T.13.11.A11.1.454.light.4.raw

SEQ ID NO: 560643 - DNA, 507 bp, Homo sapiens
  misc_feature: HIJSMM301B13SV.4.57.F02.1.454.light.4.raw
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcggattcgtctaggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaactccactgtcact

SEQ ID NO: 560644 - DNA, 480 bp, Homo sapiens; identical to SEQ ID NO: 535442
  misc_feature: HIJSMM301DIA8R.41.17.B06.1.454.light.4.raw

SEQ ID NO: 560645 - DNA, 504 bp, Homo sapiens
  misc_feature: HIJSMM301D6FMD.40.67.G01.1.454.light.4.raw
tctagcgactcacgaccggtgctcgatttagagtatacatattgggtttggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccagggccactggcgtcccggccaggttcagtggcagtgggtctgggacagccttcactctcaccatcagcagcctggagcccgaagattttgcggtttattactgtcagcagcgtgccgactggcccctcacgttcggcggagggaccaaggtggacatcaaacgaactgtggctgcaccatctgtcttcatcttcccgcc

SEQ ID NO: 560646 - DNA, 480 bp, Homo sapiens; identical to SEQ ID NO: 553480
  misc_feature: HIJSMM301B254O.21.25.C03.1.454.light.4.raw

SEQ ID NO: 560647 - DNA, 499 bp, Homo sapiens
  misc_feature: HIJSMM301BMTF8.52.78.H01.1.454.light.4.raw
cgcagtacgacacgaccggtgctcgatttagtgtgagtagtttgggtttgggggaggaactgctcagttaggacccagagggaaccatggaagccccagctcagcttctcttcctcctgctactctggctcccagataccaccggagaagttgtattgacacagtctccagccaccctgtctttgtctccaggggggagagccaccctctcctgcagggccagtcagagtgttggcaacctcttagcctggtaccaacaaaaacctggccaggctcccaggctcctcatctatgatgcatccacgagggccactggcatcccagccaggttcagtggcagtgggtctgagacagacttcactctcaccatcagtggcctcgagcctgaagattttgcagtttattactgtcagcagcgtagccactggctctctttcggcggaggaccaaggttgagatcaaacgaactgtggctgcaccatctgtcttcatcttcccg

SEQ ID NO: 560648 - DNA, 485 bp, Homo sapiens
  misc_feature: HIJSMM301AGRDG.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtaggtggaggctgaggatgttggggtttattactgcatgcaagttctacaaacttcctacacttttggccaggggaccaagctggagatcaacgaa

SEQ ID NO: 560649 - DNA, 481 bp, Homo sapiens; identical to SEQ ID NO: 535993
  misc_feature: HIJSMM301B8D5M.21.25.C03.1.454.light.4.raw

SEQ ID NO: 560650 - DNA, 486 bp, Homo sapiens; identical to SEQ ID NO: 535043
  misc_feature: HIJSMM301A116Q.46.35.D02.1.454.light.4.raw

SEQ ID NO: 560651 - DNA, 494 bp, Homo sapiens; identical to SEQ ID NO: 534992
  misc_feature: HIJSMM301DCR5Q.9.1.A01.1.454.light.4.raw

SEQ ID NO: 560652 - DNA, 477 bp, Homo sapiens
  misc_feature: HIJSMM301DKAXU.48.10.A10.1.454.light.4.raw
agtatacatacacgaccggtgctcgatttagcgtcgatctcagggggcaggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggaccttcggccaaggaccaggtggaatcaacgaactgtggctgcaccat

SEQ ID NO: 560653 - DNA, 496 bp, Homo sapiens; identical to SEQ ID NO: 539822
  misc_feature: HIJSMM301CUHI5.18.11.A11.1.454.light.4.raw

SEQ ID NO: 560654 - DNA, 474 bp, Homo sapiens; identical to SEQ ID NO: 544751
  misc_feature: HIJSMM301EVG61.3.38.D05.1.454.light.4.raw

SEQ ID NO: 560655 - DNA, 494 bp, Homo sapiens; identical to SEQ ID NO: 534992
  misc_feature: HIJSMM301DG08K.9.1.A01.1.454.light.4.raw

SEQ ID NO: 560656 - DNA, 467 bp, Homo sapiens
  misc_feature: HIJSMM301DWGWW.11.70.G04.1.454.light.4.raw
cgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgcatccactctgcaatcaggggtcccatctcgattcagtggcagtggatctgggacagatttcactctcaccatcagcagcctgcagcctgaagatgttgcaacttattactgtcaaaagaatagcgctgccccgctcagtttcggcggagggaccaaggtggagatacg

SEQ ID NO: 560657 - DNA, 510 bp, Homo sapiens
  misc_feature: HIJSMM301B554V.10.26.C04.1.454.light.4.raw
catagtagtgcacgaccggtgctcgattagtctagcgactttgggtttgggggctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtcccgtggacgttcggccaggaccaggtggcatcaaccgactgtggctgcacatctgtcttcatcttcccgccta

SEQ ID NO: 560658 - DNA, 486 bp, Homo sapiens
  misc_feature: HIJSMM301AULNJ.14.68.G02.1.454.light.4.raw
cgtctagtaccacgaccggtgctcgatttagtcgatagtgaagggaaagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacatcaggaaatatttaaattggtatcagcagaaaccagggaaagcccctaaactcctgatcttcgatgcatccaatttggaaacaggggtcccatcaaggttcaggggaagtggatctgggacagattttagtttcaccatcagcagcctgcagcctgaagatattggaacatattactgtcaacagtatgataatttaccgctcactttcggcggagggaccaaggtggacatcaaacgaactgtggctgcacat

SEQ ID NO: 560659 - DNA, 478 bp, Homo sapiens; identical to SEQ ID NO: 541915
  misc_feature: HIJSMM301EGO5Q.13.59.F04.1.454.light.4.raw

SEQ ID NO: 560660 - DNA, 496 bp, Homo sapiens
  misc_feature: HIJSMM301EL51J.26.12.B01.1.454.light.4.raw
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtatcccggccagattcagtggcagggggtctgggacagaattcactctcaccatcagcagcctgcagtctgaagattgtgcaatttattactgtcagcaatataatacctggcctccgctcactttcggcggagggaccaaggttgagatcaaacgaactgtggctgcacca

SEQ ID NO: 560661 - DNA, 354 bp, Homo sapiens
  misc_feature: HIJSMM301BYFHK.3.57.F02.1.454.light.4.raw
agacgcactccacgaccggtgctcgatttagctcgatatagttgggtttgggggtgtggtggtctccactcccgccttgacggggctgctatctgccttccaggcccctatcctggtcatcaattatgacagcgaccggccctcagggatccctgagcgattctctggctccaactctgggaacacggccaccctgaccatcagcagggtcgaagccggggatgaggccgactattcttgtcaggtgtgggatagtagtactgtgatattcggcggagggaccaagctgaccgtcctaggtcagcccaaggctgccccctcggtcactctgttcccgcctcctcgagtgcgtct

SEQ ID NO: 560662 - DNA, 503 bp, Homo sapiens
  misc_feature: HIJSMM301D2ISI.4.71.G05.1.454.light.4.raw
agcactgtagcacgaccggtgctcgatttagtgtcgtcgcaagagagagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataatttctgggtgttcggcggagggaccaaactgaccgtcctaggtcagcccaaggctgccccctcggtcactctgtt

SEQ ID NO: 560663 - DNA, 447 bp, Homo sapiens; identical to SEQ ID NO: 535201
  misc_feature: HIJSMM301AV1FO.18.9.A09.1.454.light.4.raw

SEQ ID NO: 560664 - DNA, 514 bp, Homo sapiens; identical to SEQ ID NO: 546882
  misc_feature: HIJSMM301D6VEA.43.23.C01.1.454.light.4.raw

SEQ ID NO: 560665 - DNA, 511 bp, Homo sapiens
  misc_feature: HIJSMM301AH3C7.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggtcggagggaccgaacggtaggacctcaaacgaactagtggctgcaccatctgtcttcatcttcccgccc

SEQ ID NO: 560666 - DNA, 484 bp, Homo sapiens; identical to SEQ ID NO: 551212
  misc_feature: HIJSMM301AYHKU.3.10.A10.1.454.light.4.raw

SEQ ID NO: 560667 - DNA, 496 bp, Homo sapiens; identical to SEQ ID NO: 547092
  misc_feature: HIJSMM301EQU56.53.11.A11.1.454.light.4.raw

SEQ ID NO: 560668 - DNA, 517 bp, Homo sapiens; identical to SEQ ID NO: 552423
  misc_feature: HIJSMM301CZ3CY.22.30.C08.1.454.light.4.raw

SEQ ID NO: 560669 - DNA, 489 bp, Homo sapiens; identical to SEQ ID NO: 546040
  misc_feature: HIJSMM301EAV3E.11.12.B01.1.454.light.4.raw

SEQ ID NO: 560670 - DNA, 447 bp, Homo sapiens
  misc_feature: HIJSMM301DCJYO.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctgagtcagcccaaggccaacccctctcgtcactctgttcccaccctcctccatactcta

SEQ ID NO: 560671 - DNA, 500 bp, Homo sapiens; identical to SEQ ID NO: 560122
  misc_feature: HIJSMM301AWH80.9.81.H04.1.454.light.4.raw

SEQ ID NO: 560672 - DNA, 489 bp, Homo sapiens
  misc_feature: HIJSMM301C8K3N.19.71.G05.1.454.light.4.raw
tactctcgtgcacgaccggtgctcgatttagtgtcgtcgcaagagagaggggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaaggtggatatcagacgaa

SEQ ID NO: 560673 - DNA, 511 bp, Homo sapiens
  misc_feature: HIJSMM301AUCMQ.17.41.D08.1.454.light.4.raw
cgtagactagcacgaccggtgctcgatttagtcacgcgagaaagggaaagggggaagagctgctcagttaggacccagagggaaccatggaaaccccagcgcagcttctcttcctcctgctactctggctcccagataccaccggagaaattgtgttgacgcagtctccaggcaccctgtccttgtctccaggggaaacagccaccctctcctgtagggccagtcagagtgtttttaaaaactatttagcctggtaccaacagaagcctggccaggctcccaggctcctcatctatggtgcatccaccagggccactggcatcccagacaggttcagtggcggtgggtctgggacagaattcactctcaccatcaccagtctggagcctgaagattttgctctgtatcactgtcagcaatatggtggtacacccctcactttcggcggaggggccgaaggtggagatcaagcgaactgtggctgcaccatctgtcttcatcttcccgccat

SEQ ID NO: 560674 - DNA, 485 bp, Homo sapiens; identical to SEQ ID NO: 536630
  misc_feature: HIJSMM301DKFXQ.13.56.F01.1.454.light.4.raw

SEQ ID NO: 560675 - DNA, 495 bp, Homo sapiens; identical to SEQ ID NO: 535486
  misc_feature: HIJSMM301BDZZ3.26.72.G06.1.454.light.4.raw

SEQ ID NO: 560676 - DNA, 502 bp, Homo sapiens; identical to SEQ ID NO: 541501
  misc_feature: HIJSMM301EECG3.17.27.C05.1.454.light.4.raw

SEQ ID NO: 560677 - DNA, 502 bp, Homo sapiens
  misc_feature: HIJSMM301BM4LK.15.37.D04.1.454.light.4.raw
tctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatgacccagtctccttccaccctgtctgcatctgtaggagacagagtcaccttcacttgccgggccagtcaaaatattactaggtggttggcctggtatcagcagaaaccagggaaggcccctaagtccctcatcaagaaggcgtctactttagaagctggggtcccgtcaagattcagcgccggtggatctgggacagaattcactctcaccatcaacagcctggaacctgatgattttgcaacttattactgccaacactatgatactcacccgtacacttttggccaggggaccaagcctggagatcaaaggaactgtggctgcaccatctgtcttcatcttcccg

SEQ ID NO: 560678 - DNA, 500 bp, Homo sapiens; identical to SEQ ID NO: 553383
  misc_feature: HIJSMM301BTNZS.18.11.A11.1.454.light.4.raw

SEQ ID NO: 560679 - DNA, 486 bp, Homo sapiens; identical to SEQ ID NO: 535043
  misc_feature: HIJSMM301AZPGL.46.35.D02.1.454.light.4.raw

SEQ ID NO: 560680 - DNA, 484 bp, Homo sapiens; identical to SEQ ID NO: 535400
  misc_feature: HIJSMM301B0JDG.46.26.C04.1.454.light.4.raw

SEQ ID NO: 560681 - DNA, 503 bp, Homo sapiens; identical to SEQ ID NO: 537841
  misc_feature: HIJSMM301AUFR7.48.71.G05.1.454.light.4.raw

SEQ ID NO: 560682 - DNA, 492 bp, Homo sapiens
  misc_feature: HIJSMM301A9VW3.15.67.G01.1.454.light.4.raw
tctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagatttcactctcaccatcagcagcctgcagcctgaagatttcgcaacttattactgtctacaagattacaattaccctcggacgttcggccgagggaccgaacggtaggaaatacaaacgaactagtggctgcacca

SEQ ID NO: 560683 - DNA, 481 bp, Homo sapiens
  misc_feature: HIJSMM301CNGN0.22.59.F04.1.454.light.4.raw
acatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgttagcagcagcttagcctggtaccagcagaaacctggccaggctcccaggcctcctcatctatggtgcatctacgagggccactggtatcccagccaggttcagtggcagtgggtctgggacagagttcactctcaccatcagcagcctgcagtctgaagattttgcagtttattactgtcagcactataataactggcctccgtacagttttggccaggggaccaagctggagatcaaacgaa

SEQ ID NO: 560684 - DNA, 486 bp, Homo sapiens
  misc_feature: HIJSMM301EWTT2.47.48.E04.1.454.light.4.raw
agctcacgtacacgaccggtgctcgatttagagagcgtcacagagagaaggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttcggccaagggaccgaaggtggaaagtacaaacgaactagtggctgcacca

SEQ ID NO: 560685 - DNA, 491 bp, Homo sapiens; identical to SEQ ID NO: 536211
  misc_feature: HIJSMM301CD5NQ.16.53.E09.1.454.light.4.raw

SEQ ID NO: 560686 - DNA, 491 bp, Homo sapiens; identical to SEQ ID NO: 536211
  misc_feature: HIJSMM301ALUGN.16.53.E09.1.454.light.4.raw

SEQ ID NO: 560687 - DNA, 503 bp, Homo sapiens; identical to SEQ ID NO: 536834
  misc_feature: HIJSMM301CLV8W.2.35.D02.1.454.light.4.raw

SEQ ID NO: 560688 - DNA, 522 bp, Homo sapiens
  misc_feature: HIJSMM301AWXYF.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccagggctgaccgtcctaggtcagcccaaggctgccccctcggtcactctgttcccgccct

SEQ ID NO: 560689 - DNA, 503 bp, Homo sapiens; identical to SEQ ID NO: 540136
  misc_feature: HIJSMM301CNB66.19.10.A10.1.454.light.4.raw

SEQ ID NO: 560690 - DNA, 494 bp, Homo sapiens; identical to SEQ ID NO: 536221
  misc_feature: HIJSMM301EHOQS.15.59.F04.1.454.light.4.raw

SEQ ID NO: 560691 - DNA, 531 bp, Homo sapiens
  misc_feature: HIJSMM301CPS39.19.78.H01.1.454.light.4.raw
tactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcgtacggtcgtatcttctttagtcgttcgttcggaacgtgggaaccaaggtccacccgtccttaggtcacgacccgaacggacccaaaccccctactgtaccta

SEQ ID NO: 560692 - DNA, 444 bp, Homo sapiens; identical to SEQ ID NO: 536685
  misc_feature: HIJSMM301AOYBA.10.76.G10.1.454.light.4.raw

SEQ ID NO: 560693 - DNA, 464 bp, Homo sapiens
  misc_feature: HIJSMM301CDFXM.51.33.C11.1.454.light.4.raw
cgatcgtatacacgaccggtgctcgatttagagtgagctcgttgggtttgggggagtcagtcccaaccaggacacagcatggacatgagggtccctgctcagctcctggggctcctgctgctctggctctcaggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagtattttactttctaccatcagcaggctgcagcctgaagacattgcaacatattactgtcaacagtatgatagtctcccgctcactttcggcgggggaccaaggtggagatcaagcgaactgtggctgcaccatctgtcttcatccttcccgccatctgatcgtagcact

SEQ ID NO: 560694 - DNA, 486 bp, Homo sapiens; identical to SEQ ID NO: 535043
  misc_feature: HIJSMM301CAFKU.46.35.D02.1.454.light.4.raw

SEQ ID NO: 560695 - DNA, 499 bp, Homo sapiens
  misc_feature: HIJSMM301AUD5Y.2.34.D01.1.454.light.4.raw
acgctcgacacacgaccggtgctcgatttagatcgtctgtgttgggtttgggggctttgcctgggctctgctcctcctcaccctcctcactcagggcacagggtcctgggcccagtctgccctgactcagcccccctccgcgtccgggtctcctggacagtcagtcaccatctcctgcactggaatcagcagtgacctgagtccttataactatgtctcctggtaccaacaacacccaggcaaagcccccaaactcattatttatgaagtcactaagcggccctcaggggtccctgatcgcttctctggctccaagtctggcgagacggcctccctgaccgtctctgggctccaggctgaagatgaggctgattattactgcagctcatatgcaggcagcaacaatgtggcattcggcggagggaccaagctgaccgtcctgggtcagcccaaggctgccccctcggtcactctgttcccaccctcctctgtcgagcgt

SEQ ID NO: 560696 - DNA, 504 bp, Homo sapiens
  misc_feature: HIJSMM301EHUUZ.19.78.H01.1.454.light.4.raw
tactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagccccaaggcccaaccccactg

SEQ ID NO: 560697 - DNA, 434 bp, Homo sapiens
  misc_feature: HIJSMM301ASQDY.41.8.A08.1.454.light.4.raw
tctatactatcacgaccggtgctcgatttagcatactctacagggaagatggagactgcgacatccagatgacccagtctccatcttccctgtctgcatctgtaggagacagagtcaccatcacttgtcgggcgagtcaggatattagcagctttttagcctggtatcagcagagaccagggaaagcccctaaactcctgatctatgctgcatccagtttgcaaagtggggtcccatcaaggttcagcggcagtggatctgggacagatttcactctcaccatcagcagcctgcagcctgacgattttgcaacttactattgtcaacaggctaacagtttcccgatgaccgtcggccaagggacacgactggacattaaacgaactgtggctgcaccatctgtcttcatcttcccgccatctgaatagtataga

SEQ ID NO: 560698 - DNA, 503 bp, Homo sapiens; identical to SEQ ID NO: 559148
  misc_feature: HIJSMM301AVE1D.7.31.C09.1.454.light.4.raw

SEQ ID NO: 560699 - DNA, 472 bp, Homo sapiens; identical to SEQ ID NO: 536302
  misc_feature: HIJSMM301BQ8LQ.18.76.G10.1.454.light.4.raw

SEQ ID NO: 560700 - DNA, 513 bp, Homo sapiens; identical to SEQ ID NO: 535244
  misc_feature: HIJSMM301DMFTA.17.33.C11.1.454.light.4.raw

SEQ ID NO: 560701 - DNA, 502 bp, Homo sapiens; identical to SEQ ID NO: 536253
  misc_feature: HIJSMM301DGU3R.21.22.B11.1.454.light.4.raw

SEQ ID NO: 560702 - DNA, 485 bp, Homo sapiens; identical to SEQ ID NO: 546273
  misc_feature: HIJSMM301CGAG3.43.36.D03.1.454.light.4.raw

SEQ ID NO: 560703 - DNA, 515 bp, Homo sapiens
  misc_feature: HIJSMM301ANWZV.16.83.H06.1.454.light.4.raw
tgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtggccccaggacagacggccagcataacctgtgggggaaacggccttggacgtaaaagtgtgcactggtaccagcagaagccaggccaggcccctgtgctggtcgtctatgatgatagcgaccggccctcagggatccctgagcgattctctggctccaactctgggaacgcggccaccctgaccatcagcagggtcgaagccggggatgaggccgactattactgtcaggtgtgggatagtagtagtgatcattatgtcttcggatctgggaccagggtcaccgtcctaggtcagcccaaggccaaccccactgtcactctgttcccgccctcc

SEQ ID NO: 560704 - DNA, 473 bp, Homo sapiens
  misc_feature: HIJSMM301EF9H4.48.28.C06.1.454.light.4.raw
agtatacatacacgaccggtgctcgatttagagctcacgtattgggtttggggggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggcctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagccc

SEQ ID NO: 560705 - DNA, 482 bp, Homo sapiens
  misc_feature: HIJSMM301C7OST.17.34.D01.1.454.light.4.raw
cgtagactagcacgaccggtgctcgatttagatcgtctgtgttgggtttgggtcatcacaatatctgcactggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttatactgtatgcaaggtatagagcttcctccgacgttcggccaagggaccaaggtggaactcaaacgaactgtggctgcaccatctgtcttcatcttcccgcatctgactagtctacg

SEQ ID NO: 560706 - DNA, 498 bp, Homo sapiens
  misc_feature: HIJSMM301E38EY.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactacttactcaatgatcaccttcgcaacggacgacgacctaggagattaacgtaaactacgtggcgtgcaccaactctgtctt

SEQ ID NO: 560707 - DNA, 498 bp, Homo sapiens
  misc_feature: HIJSMM301AKQNU.10.79.H02.1.454.light.4.raw
catagtagtgcacgaccggtgctcgatttagtgtcacacgaagggaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcaacagactggagtctgaagattttgcagtgtattattgtcagcaatatggtaggtcacctgggacttttggccaggggaccaagctggagatcaaacgaactgtggctgcaccatctgtcttcta

SEQ ID NO: 560708 - DNA, 486 bp, Homo sapiens
  misc_feature: HIJSMM301D4H7A.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcggcggagggaccaaggtggagatcaaacgaa

SEQ ID NO: 560709 - DNA, 493 bp, Homo sapiens
  misc_feature: HIJSMM301EL8Q6.11.59.F04.1.454.light.4.raw
  modified_base (476)..(476): a, c, t, g, unknown or other
cgagagataccacgaccggtgctcgatttagtacacacacttagggattggggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctccaagtctggcaacacggcctcctgaacatctctgggctccaggctgaggatgaggctgattattattgctgctcatatgaagtacctactctttctcttcggaactgggaccacggtcaccgtctaggtcagcccaaggccaacccatgtcactctgttcccncctcctcgtatctctcg

SEQ ID NO: 560710 - DNA, 477 bp, Homo sapiens; identical to SEQ ID NO: 545166
  misc_feature: HIJSMM301DO5ZX.5.28.C06.1.454.light.4.raw

SEQ ID NO: 560711 - DNA, 497 bp, Homo sapiens
  misc_feature: HIJSMM301BWILN.10.28.C06.1.454.light.4.raw
catagtagtgcacgaccggtgctcgatttagagctcacgtattgggtttggggctttgcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagcccccaaactgatgatttatgatgtcagtaatcgaccctcaggggtttctgatcgcttctttgcctccaagtctggcaacacggcctccctgaccatctctgggctccagactgaggacgaggctgattattactgcagctcacatacaagcggcagcggttgggtgttcggcggggggaccacactgaccgtcctaggtcagcccaaggctgcccctcggtcactctgttcccgccctcctccactactatg

SEQ ID NO: 560712 - DNA, 501 bp, Homo sapiens
  misc_feature: HIJSMM301EXI4T.5.24.C02.1.454.light.4.raw
atcagacacgcacgaccggtgctcgatttagtacagatcgttagggaaagggggctggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaaggctgaccgtcctaggtcagcccaagg

SEQ ID NO: 560713 - DNA, 488 bp, Homo sapiens
  misc_feature: HIJSMM301DVEO9.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctcgaccgtcctgcgtcagcccaaggctcgccccctcggtcactctcgttcccgccctcctcgctacgtaga

SEQ ID NO: 560714 - DNA, 510 bp, Homo sapiens
  misc_feature: HIJSMM301AMPLG.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctcgccccctcggtcactctgtt

SEQ ID NO: 560715 - DNA, 482 bp, Homo sapiens
  misc_feature: HIJSMM301BOLLV.40.83.H06.1.454.light.4.raw
tctagcgactcacgaccggtgctcgatttagatcacgtgcgtcgcgggaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttcagcatggacggcagcctcagtgaatgggtgttcggcggagggaccaaactgtccgtcctaggtcagcccaa

SEQ ID NO: 560716 - DNA, 463 bp, Homo sapiens; identical to SEQ ID NO: 535062
  misc_feature: HIJSMM301B5N08.11.73.G07.1.454.light.4.raw

SEQ ID NO: 560717 - DNA, 492 bp, Homo sapiens; identical to SEQ ID NO: 535126
  misc_feature: HIJSMM301ALNLL.18.11.A11.1.454.light.4.raw

SEQ ID NO: 560718 - DNA, 486 bp, Homo sapiens; identical to SEQ ID NO: 535458
  misc_feature: HIJSMM301B0ERS.7.75.G09.1.454.light.4.raw

SEQ ID NO: 560719 - DNA, 483 bp, Homo sapiens; identical to SEQ ID NO: 535413
  misc_feature: HIJSMM301BCPZ6.26.78.H01.1.454.light.4.raw

SEQ ID NO: 560720 - DNA, 522 bp, Homo sapiens; identical to SEQ ID NO: 538091
  misc_feature: HIJSMM301BHR1K.27.23.C01.1.454.light.4.raw

SEQ ID NO: 560721 - DNA, 492 bp, Homo sapiens; identical to SEQ ID NO: 539815
  misc_feature: HIJSMM301D8PAM.51.81.H04.1.454.light.4.raw

SEQ ID NO: 560722 - DNA, 489 bp, Homo sapiens; identical to SEQ ID NO: 543809
  misc_feature: HIJSMM301EHFAN.19.71.G05.1.454.light.4.raw

SEQ ID NO: 560723 - DNA, 514 bp, Homo sapiens; identical to SEQ ID NO: 546238
  misc_feature: HIJSMM301EI8C5.47.85.H08.1.454.light.4.raw

SEQ ID NO: 560724 - DNA, 494 bp, Homo sapiens
  misc_feature: HIJSMM301EZTXK.26.72.G06.1.454.light.4.raw
  modified_base (409)..(409): a, c, t, g, unknown or other
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaanattttcgtgctccgtacacttttggccaggggacccaggtggagatcagacgaactgtggctgcaccatctgtcttcatcttccg

SEQ ID NO: 560725 - DNA, 485 bp, Homo sapiens; identical to SEQ ID NO: 536576
  misc_feature: HIJSMM301BRMTX.46.35.D02.1.454.light.4.raw

SEQ ID NO: 560726 - DNA, 496 bp, Homo sapiens
  misc_feature: HIJSMM301BFAEI.9.53.E09.1.454.light.4.raw
tgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggaccaaggtgaccgtcctaggtcagcccaaggctg

SEQ ID NO: 560727 - DNA, 514 bp, Homo sapiens
  misc_feature: HIJSMM301ERBQW.40.46.E02.1.454.light.4.raw
tctagcgactcacgaccggtgctcgatttagactcatctacagggaaaggggctgggcctaaggaagcagcactggtggtgcctcagccatggcctggaccgttctcctcctcggcctcctctctcactgcacagggtctgtgacctcctatgtgctgactcagccactctcggtgtctgtggccccaggacaggcggccaatgttacctgtgggggagacaacattgggagtaaaagtgtgcactggtaccagctgaagccaggccaggcccctgtgttggtcgtctttggacatggtgcccgaccctcggggatccctgagcgattctctgcctccaggtctgggaacacggccaccctgaccatcaccagggtcgaggccggagatgaggccgactattttgtcacgtgtggcacgttagtcatcacgtcttcggaactgggaccacggtcaccgtcctaagtcagcccaaggccaacccactgtcactctgttcccgccctcctcagtcg

SEQ ID NO: 560728 - DNA, 482 bp, Homo sapiens; identical to SEQ ID NO: 544159
  misc_feature: HIJSMM301D71J6.4.74.G08.1.454.light.4.raw

SEQ ID NO: 560729 - DNA, 444 bp, Homo sapiens; identical to SEQ ID NO: 535856
  misc_feature: HIJSMM301BAXJL.9.9.A09.1.454.light.4.raw

SEQ ID NO: 560730 - DNA, 491 bp, Homo sapiens; identical to SEQ ID NO: 535294
  misc_feature: HIJSMM301BIRZL.16.68.G02.1.454.light.4.raw

SEQ ID NO: 560731 - DNA, 504 bp, Homo sapiens
  misc_feature: HIJSMM301AZ04P.5.24.C02.1.454.light.4.raw
atcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcgggggaccaagctgaccgtcctaggtcagcccaaggctgcccccg

SEQ ID NO: 560732 - DNA, 485 bp, Homo sapiens
  misc_feature: HIJSMM301C5WWA.48.59.F04.1.454.light.4.raw
agtatacatacacgaccggtgctcgatttagtacacacacttagggattgggggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccttcacttgccgggcaagtcaggacattaaaagtgatttagcctggtatcagcagaaaccagggagagcccctaagctcctcatctatgctgcttccattttacaaagtggagtctcatcaaggttcagcggcggtggatctggcacagatttcactctcaccatcagcagcctgcagcctgaagattttgcaacttattactgtctgcacgattacaattaccctcggacgttcggccaagggaccaaggtggaaggtcaaacgaactagtggctgcacca

SEQ ID NO: 560733 - DNA, 479 bp, Homo sapiens
  misc_feature: HIJSMM301BXREV.51.60.F05.1.454.light.4.raw
cgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaagcggccctcggggatacctgagcgattctctggctccacctctgggaacacagccactctgaccatcagcgggacgcaggctgtggatgaggctgacttttactgtcaggcgtgggacagcgacactgccgtgttcggcggagggccaagctgaccgtcctcggtcagcccaaggctcg

SEQ ID NO: 560734 - DNA, 485 bp, Homo sapiens; identical to SEQ ID NO: 536576
  misc_feature: HIJSMM301CULWN.46.35.D02.1.454.light.4.raw

SEQ ID NO: 560735 - DNA, 475 bp, Homo sapiens
  misc_feature: HIJSMM301B2HEW.40.59.F04.1.454.light.4.raw
tctagcgactcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgactgtcctaagtcacg

SEQ ID NO: 560736 - DNA, 489 bp, Homo sapiens
  misc_feature: HIJSMM301CEMAL.3.10.A10.1.454.light.4.raw
agacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcggattcgtctagggctccagctcagggacaacagtcacgttgaccatcagtggagtccaggcagaggacgaggctgactattattgtcaatcagcagacaacagtaatacttatctttatgtcttcggatctgggaccagggtcaccgtcctaggtcagcccaaggccaa

SEQ ID NO: 560737 - DNA, 466 bp, Homo sapiens
  misc_feature: HIJSMM301A6ZC3.11.70.G04.1.454.light.4.raw
cgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgcatccactctgcaatcaggggtcccatctcgattcagtggcagtggatctgggacagatttcactctcaccatcagcagcctgcagcctgaagatgttgcaacttattactgtcaaaagaatagcgctgcccccgctcagtttcggcggagggaccaaggtggagatac

SEQ ID NO: 560738 - DNA, 480 bp, Homo sapiens
  misc_feature: HIJSMM301C8W4W.48.19.B08.1.454.light.4.raw
agtatacatacacgaccggtgctcgatttagtgagtcagtaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgctgctcatatgcaggcagctacacttgggtgttcggcggagggaccaagctgaccgtctaggtcacg

SEQ ID NO: 560739 - DNA, 506 bp, Homo sapiens; identical to SEQ ID NO: 553279
  misc_feature: HIJSMM301CX1NZ.14.3.A03.1.454.light.4.raw

SEQ ID NO: 560740 - DNA, 460 bp, Homo sapiens; identical to SEQ ID NO: 540069
  misc_feature: HIJSMM301BQVL6.11.86.H09.1.454.light.4.raw

SEQ ID NO: 560741 - DNA, 480 bp, Homo sapiens
  misc_feature: HIJSMM301BTEUN.21.25.C03.1.454.light.4.raw
tcgtcgctcgcacgaccggtgctcgatttagtagtgtagatttgggtttgggggctgttcctggaagttgctgataccagtgcacattcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggcctcaggggtccctgaccgattctctggctccaagtctggcacctcagcctccctggtcatcgctgggctccaggctgacgatgaggctgattatattgccagtcctatgacaacaccctgcgtggttttggctgttcggcggcgggacc

SEQ ID NO: 560742 - DNA, 477 bp, Homo sapiens
  misc_feature: HIJSMM301D9VJ2.11.17.B06.1.454.light.4.raw
cgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccgggcaagtcagatcattagcagctatttaaattggtatcagcagaaaccagggaaagcccctgaggtcctgatctatgctgcatccagtttgcagagtggggtcccatcaaggttcagtggcagtggatctgcgacagatttcactctcaccatcagcagtctgcaacctgaagattttgcaacttactactgtcaacagagttacagtaccccgtggacgttcggccaaggaccaagtggaaatcaaacgaactacgtggctgca

SEQ ID NO: 560743 - DNA, 486 bp, Homo sapiens; identical to SEQ ID NO: 537144
  misc_feature: HIJSMM301CFEJF.46.35.D02.1.454.light.4.raw

SEQ ID NO: 560744 - DNA, 484 bp, Homo sapiens; identical to SEQ ID NO: 535400
  misc_feature: HIJSMM301EF2FD.46.26.C04.1.454.light.4.raw

SEQ ID NO: 560745 - DNA, 520 bp, Homo sapiens; identical to SEQ ID NO: 535773
  misc_feature: HIJSMM301CD6CZ.41.19.B08.1.454.light.4.raw

SEQ ID NO: 560746 - DNA, 484 bp, Homo sapiens; identical to SEQ ID NO: 535400
  misc_feature: HIJSMM301A71NQ.46.26.C04.1.454.light.4.raw

SEQ ID NO: 560747 - DNA, 484 bp, Homo sapiens
  misc_feature: HIJSMM301B8L8P.17.25.C03.1.454.light.4.raw
cgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacagatttcaatctcaccatcaccactctgcaacctgaggattgtgcaatctactactgtcaacagagttacagttcccctcgcactttggccaggggaccaagttgagatcaaacgaactgtggctgcaccatctgt

SEQ ID NO: 560748 - DNA, 497 bp, Homo sapiens; identical to SEQ ID NO: 535764
  misc_feature: HIJSMM301DJ96I.22.20.B09.1.454.light.4.raw

SEQ ID NO: 560749 - DNA, 487 bp, Homo sapiens
  misc_feature: HIJSMM301DB1MT.8.80.H03.1.454.light.4.raw
ctcgcgtgtccacgaccggtgctcgatttagctgtgcgtcgaagggaaagggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctacttagcctggtatcagcagaaaccagggaaagcccctaacctcctgatccatactgcatccagcttgcaaagtgggtcccatcaaggttcagcggcagtggatctgggacagatttcactctcaccatcagcagcctgcagcctgaagattttgcaacttactattgtcaacaggctgccggtttcccttggacgttcggccaagggaccaaggtggaaatcaaacgaactagtggctgcaccatctgtt

SEQ ID NO: 560750 - DNA, 510 bp, Homo sapiens
  misc_feature: HIJSMM301CM4Y0.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccta

SEQ ID NO: 560751 - DNA, 486 bp, Homo sapiens
  misc_feature: HIJSMM301C7I0Y.48.55.E11.1.454.light.4.raw
agtatacatacacgaccggtgctcgatttagcactcgcacgttgggtttgggggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccttcacttgccgggcaagtcaggacattaaaagtgatttagcctggtatcagcagaaaccagggagagcccctaagctcctcatctatgctgcttccattttacaaagtggagtctcatcaaggttcagcggcggtggatctggcacagatttcactctcaccatcagcagcctgcagcctgaagattttgcaacttattactgtctgcacgattacaattaccctcggacgttcggtccaagggaccaaggtggaagtcaacgaaactgtggcgtgcaccta

SEQ ID NO: 560752 - DNA, 487 bp, Homo sapiens; identical to SEQ ID NO: 536025
  misc_feature: HIJSMM301CK04G.17.34.D01.1.454.light.4.raw

SEQ ID NO: 560753 - DNA, 485 bp, Homo sapiens; identical to SEQ ID NO: 535648
  misc_feature: HIJSMM301CLNT3.17.36.D03.1.454.light.4.raw

SEQ ID NO: 560754 - DNA, 496 bp, Homo sapiens; identical to SEQ ID NO: 537925
  misc_feature: HIJSMM301DA77W.22.14.B03.1.454.light.4.raw

SEQ ID NO: 560755 - DNA, 504 bp, Homo sapiens; identical to SEQ ID NO: 555965
  misc_feature: HIJSMM301D5KTI.48.36.D03.1.454.light.4.raw

SEQ ID NO: 560756 - DNA, 503 bp, Homo sapiens
  misc_feature: HIJSMM301CR0HN.4.57.F02.1.454.light.4.raw
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactggaccaaggtctccgtcctacgtcagcccaaggccaactccactgtcact

SEQ ID NO: 560757 - DNA, 502 bp, Homo sapiens; identical to SEQ ID NO: 541971
  misc_feature: HIJSMM301D9H87.4.39.D06.1.454.light.4.raw

SEQ ID NO: 560758 - DNA, 499 bp, Homo sapiens
  misc_feature: HIJSMM301BNWDO.48.83.H06.1.454.light.4.raw
agtatacatacacgaccggtgctcgatttagatcacgtgcgtcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctcaggctgaggacgaggctgattattactgcacctcatatacaagcaagcagcactctcgtggtattcggcggagggaccaagctgaccgtcctaggtcagcccaaggctgccccctc

SEQ ID NO: 560759 - DNA, 494 bp, Homo sapiens
  misc_feature: HIJSMM301BX2OR.13.10.A10.1.454.light.4.raw
tcacgtactacacgaccggtgctcgatttagcgtcgatctcaggggggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatctacaacacaaacactcgctcttctggggtccctcatcgcttctctggctccatccttgggaacaaagctgcccttatcatcacgggggcccaggcagaagatgaatctgattattactgtgttctttatatgggtatgccatttctgctgtgttcggaggaggcacccggctgaccgtcctcggtcagcccaagctgcccc

SEQ ID NO: 560760 - DNA, 493 bp, Homo sapiens; identical to SEQ ID NO: 535657
  misc_feature: HIJSMM301BQTE9.27.78.H01.1.454.light.4.raw

SEQ ID NO: 560761 - DNA, 507 bp, Homo sapiens; identical to SEQ ID NO: 538063
  misc_feature: HIJSMM301C654R.47.85.H08.1.454.light.4.raw

SEQ ID NO: 560762 - DNA, 457 bp, Homo sapiens
  misc_feature: HIJSMM301DV48T.51.11.A11.1.454.light.4.raw
cgatcgtatacacgaccggtgctcgatttagctacgactgcaggggagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattagcatgtatctgaattggtatcagcaaaaaccagggaaagcccctaagctcctgatcctcgatgcatccaatttggaaacaggggtcccatcaaggttcagtgcaagtggctctgggacagatttcactttcaccatcagcagactgcagcctgaagatattgcaacatattactgtcaacagtatgataatctcccgctcactttcggcggagggaccaaggtggggatcaaacgaa

SEQ ID NO: 560763 - DNA, 461 bp, Homo sapiens
  misc_feature: HIJSMM301BEAD9.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagccaagcgtgcccctccgtcgactctgttcctacccctccctccctaccgacggagtaa

SEQ ID NO: 560764 - DNA, 493 bp, Homo sapiens; identical to SEQ ID NO: 547468
  misc_feature: HIJSMM301AI8SG.11.81.H04.1.454.light.4.raw

SEQ ID NO: 560765 - DNA, 503 bp, Homo sapiens; identical to SEQ ID NO: 547049
  misc_feature: HIJSMM301C0HLZ.18.59.F04.1.454.light.4.raw

SEQ ID NO: 560766 - DNA, 488 bp, Homo sapiens; identical to SEQ ID NO: 535725
  misc_feature: HIJSMM301BUHLP.12.88.H11.1.454.light.4.raw

SEQ ID NO: 560767 - DNA, 486 bp, Homo sapiens; identical to SEQ ID NO: 535043
  misc_feature: HIJSMM301E0GIS.46.35.D02.1.454.light.4.raw

SEQ ID NO: 560768 - DNA, 477 bp, Homo sapiens
  misc_feature: HIJSMM301BLC2K.41.8.A08.1.454.light.4.raw
tctatactatcacgaccggtgctcgatttagcatactctacagggggcaggagtcagacccagtcaggacacagcatggacatgagggtccccgctcagctcctggggctcctgctgctctggttcccaggttccagatgcgacatccagatgacccagtctccatcttccctgtctgcatctgtaggagacagagtcaccatcacttgtcgggcgagtcaggatattagcagctttttagcctggtatcagcagagaccagggaaagcccctaaactcctgatctatgctgcatccagtttgcaaagtggggtcccatcaaggttcagcggcagtggatctgggacagatttcactctcaccatcagcagcctgcagcctgacgattttgcaacttactattgtcaacaggctaacagtttcccgatgaccgtcggccaagggacacgactggacattaaacgaactgtggctgca

SEQ ID NO: 560769 - DNA, 469 bp, Homo sapiens; identical to SEQ ID NO: 536091
  misc_feature: HIJSMM301AHKSL.3.82.H05.1.454.light.4.raw

SEQ ID NO: 560770 - DNA, 486 bp, Homo sapiens; identical to SEQ ID NO: 535290
  misc_feature: HIJSMM301C26XI.3.12.B01.1.454.light.4.raw

SEQ ID NO: 560771 - DNA, 484 bp, Homo sapiens; identical to SEQ ID NO: 535400
  misc_feature: HIJSMM301BYPIY.46.26.C04.1.454.light.4.raw

SEQ ID NO: 560772 - DNA, 503 bp, Homo sapiens; identical to SEQ ID NO: 538884
  misc_feature: HIJSMM301ALMOW.27.78.H01.1.454.light.4.raw

SEQ ID NO: 560773 - DNA, 494 bp, Homo sapiens; identical to SEQ ID NO: 538230
  misc_feature: HIJSMM301ECUJG.11.71.G05.1.454.light.4.raw

SEQ ID NO: 560774 - DNA, 486 bp, Homo sapiens; identical to SEQ ID NO: 535043
  misc_feature: HIJSMM301BKXNG.46.35.D02.1.454.light.4.raw

SEQ ID NO: 560775 - DNA, 441 bp, Homo sapiens; identical to SEQ ID NO: 534971
  misc_feature: HIJSMM301DEBHW.11.3.A03.1.454.light.4.raw

SEQ ID NO: 560776 - DNA, 510 bp, Homo sapiens
  misc_feature: HIJSMM301CK2WC.21.87.H10.1.454.light.4.raw
tcgtcgctcgcacgaccggtgctcgatttagcagtactgcgttgggtttgggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacgttttaaccttgtctcctggtatcaacaacaccaggacaaagccccaaaactcttaatttctggcgtcaatcagcgaccctcacatgtttccagtcgattctctgcatccaagtctggcaacacggcctttctgacaatctctcaactccaggctgaagacgaggctatttaattactgctcctcatacgcaggtggcacatttttcttgggtttttggcggcgggacccagatgactgtcctcagtcagcccaaggctcgccccctcgtcc

SEQ ID NO: 560777 - DNA, 544 bp, Homo sapiens
  misc_feature: HIJSMM301AU3M0.17.33.C11.1.454.light.4.raw
cgtagactagcacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaccagcctacacgcttaaaccgggacaaccgtcgcccggccaacatagccttctccgtccccccttcgcagtaacaccaagtacaggaatattaacctgtttcccatcgactacgcctttcggcctcgccttaggggtcgactcaccctgccccgattaacgttggacaggaacccttggtcttccggcgagcgggcttttcacccgctttatcgttacttatgtcagcattcgcacttctgatacctccagcatgcctcacagcacaccttcacaggcttacagaacgctcccctacccaacaacgcataagcgtcgctgccgcagcttcggtgcatggtttagccccgtttcatcttcccgccatctgact

SEQ ID NO: 560778 - DNA, 484 bp, Homo sapiens
  misc_feature: HIJSMM301AFUTB.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccccgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggttttggctgttcggcggcgggaccaag

SEQ ID NO: 560779 - DNA, 487 bp, Homo sapiens
  misc_feature: HIJSMM301EGJPK.17.25.C03.1.454.light.4.raw
cgtagactagcacgaccggtgctcgatttagtagtgtagatttgggtttgggagtcagtctcagtcaggacacagcatggacatgagggcccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacagatttcaatctcaccatcaccactctgcaacctgaggattgtgcaatctactactgtcaacagagttacagttcccctcgcacttttggccaggggaccaaagttgagatcaaacgaactgtggctgcaccatctgtt

SEQ ID NO: 560780 - DNA, 513 bp, Homo sapiens
  misc_feature: HIJSMM301DI9R2.52.37.D04.1.454.light.4.raw
cgcagtacgacacgaccggtgctcgatttagtagcatactgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacattggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacagaaaacacttgggtgttcggcggcgggaccaaactgaccgtcctacgtcagcccaaggcctgccccctcggtcactctcg

SEQ ID NO: 560781 - DNA, 487 bp, Homo sapiens; identical to SEQ ID NO: 536536
  misc_feature: HIJSMM301BYIRM.26.45.E01.1.454.light.4.raw

SEQ ID NO: 560782 - DNA, 505 bp, Homo sapiens; identical to SEQ ID NO: 535503
  misc_feature: HIJSMM301BRH3G.8.28.C06.1.454.light.4.raw

SEQ ID NO: 560783 - DNA, 460 bp, Homo sapiens; identical to SEQ ID NO: 539553
  misc_feature: HIJSMM301E0Y8O.11.86.H09.1.454.light.4.raw

SEQ ID NO: 560784 - DNA, 512 bp, Homo sapiens
  misc_feature: HIJSMM301A2Z8D.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccgggggccactttcggccctgggaccaaacgtggatatcaaacgaactacgtggctgcaccatctcgtcttcta

SEQ ID NO: 560785 - DNA, 485 bp, Homo sapiens; identical to SEQ ID NO: 535880
  misc_feature: HIJSMM301ES9SI.7.75.G09.1.454.light.4.raw

SEQ ID NO: 560786 - DNA, 514 bp, Homo sapiens
  misc_feature: HIJSMM301EC6PD.43.19.B08.1.454.light.4.raw
tgtgagtagtcacgaccggtgctcgatttagtgagtcagtaaggggggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatccggtcttcggcggagggaccaagttgaccgtcctaagtcagcccaaggctgccccctcggtcactctgttcccgccctcctcactact

SEQ ID NO: 560787 - DNA, 482 bp, Homo sapiens
  misc_feature: HIJSMM301D0DQH.49.71.G05.1.454.light.4.raw
agtcgagagacacgaccggtgctcgatttagtgtcgtcgcaagagagagggggaccgttctcctcctcggcctcctctctcactgcacaggctctgtgaccctcctatgtgctgactcagacaccctcggtgtcggtggccccaggacagacggccttgattccctgtatgggagacgacattggaagtaagagtgtccactggtaccagcagaagccaggccaggcccctcttttggtcgtctatgatgatcgcgaccggcccgcaggggtccctgaacgattctctggcgccagctctcagaacacggccaccctgatcatcaacagggtcgaagtcggggatgaggccgactattactgtcaggtctgggatactgaaattgaatatgtcttcggaactgggaccaaagtcaccgtcctaggtcagcccaaggccaaccccactgtcactctcgttccccgccctcctctctctcgact

SEQ ID NO: 560788 - DNA, 496 bp, Homo sapiens; identical to SEQ ID NO: 535541
  misc_feature: HIJSMM301DWUM0.3.33.C11.1.454.light.4.raw

SEQ ID NO: 560789 - DNA, 503 bp, Homo sapiens; identical to SEQ ID NO: 535331
  misc_feature: HIJSMM301DHFFG.48.34.D01.1.454.light.4.raw

SEQ ID NO: 560790 - DNA, 521 bp, Homo sapiens
  misc_feature: HIJSMM301CWIQK.40.27.C05.1.454.light.4.raw
tctagcgactcacgaccggtgctcgatttagacgcgatcgaagggtttgggagacaggattcaggccaatctccagcatggccggcttccctctcctcctcaccctcctcactcactgtgcagggtcctgggcccagtctgtgctgactcagccaccctcagcgtctgagacccccgggcagcaggttaccgtctcttgttctggaagcagctccaacatcggaagtaattctgtatactggtaccagtgcctcccaggaacggcccccaaacttctcgtctatagggattatcagcggcccttaggggtccctgaccgattctctggctccaggtctggcacctcagcctccctggccatcagtgggctccggcccgaggatgaggcggattattattgtgtgtcatgggatgacagaatgaatggtccggtgttcggcggagggaccaggctgaccgtcctaggtcagcccaaggctgccccctcggtcactctgttcccaccctcctcagtcgctaga

SEQ ID NO: 560791 - DNA, 520 bp, Homo sapiens; identical to SEQ ID NO: 539176
  misc_feature: HIJSMM301AWO7H.27.23.C01.1.454.light.4.raw

SEQ ID NO: 560792 - DNA, 479 bp, Homo sapiens
  misc_feature: HIJSMM301AKLXD.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggttttggtctgttcggcggcggg

SEQ ID NO: 560793 - DNA, 492 bp, Homo sapiens; identical to SEQ ID NO: 536010
  misc_feature: HIJSMM301EKLG8.10.20.B09.1.454.light.4.raw

SEQ ID NO: 560794 - DNA, 465 bp, Homo sapiens; identical to SEQ ID NO: 540896
  misc_feature: HIJSMM301DX3NX.11.70.G04.1.454.light.4.raw

SEQ ID NO: 560795 - DNA, 504 bp, Homo sapiens
  misc_feature: HIJSMM301B9RTT.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacggggacgcaacatgggatgacaatctgagcggttgggtgttcggcggagggaccaaactgaccgtcctagggtcagcccaa

SEQ ID NO: 560796 - DNA, 493 bp, Homo sapiens; identical to SEQ ID NO: 543205
  misc_feature: HIJSMM301CC7I0.51.6.A06.1.454.light.4.raw

SEQ ID NO: 560797 - DNA, 496 bp, Homo sapiens; identical to SEQ ID NO: 537925
  misc_feature: HIJSMM301BIQ0C.22.14.B03.1.454.light.4.raw

SEQ ID NO: 560798 - DNA, 498 bp, Homo sapiens; identical to SEQ ID NO: 537020
  misc_feature: HIJSMM301BTBF0.26.26.C04.1.454.light.4.raw

SEQ ID NO: 560799 - DNA, 485 bp, Homo sapiens; identical to SEQ ID NO: 535501
  misc_feature: HIJSMM301BHDJN.3.10.A10.1.454.light.4.raw

SEQ ID NO: 560800 - DNA, 508 bp, Homo sapiens
  misc_feature: HIJSMM301B4U5I.17.33.C11.1.454.light.4.raw
cgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccg

SEQ ID NO: 560801 - DNA, 501 bp, Homo sapiens; identical to SEQ ID NO: 548193
  misc_feature: HIJSMM301EZHNS.12.48.E04.1.454.light.4.raw

SEQ ID NO: 560802 - DNA, 487 bp, Homo sapiens
  misc_feature: HIJSMM301DKHW0.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctcgccccctcggtcactctcgttcccaccctcctcgctacgtaga

SEQ ID NO: 560803 - DNA, 492 bp, Homo sapiens; identical to SEQ ID NO: 534967
  misc_feature: HIJSMM301DJEWH.47.64.F09.1.454.light.4.raw

SEQ ID NO: 560804 - DNA, 484 bp, Homo sapiens; identical to SEQ ID NO: 537891
  misc_feature: HIJSMM301CM1B9.10.1.A01.1.454.light.4.raw

SEQ ID NO: 560805 - DNA, 469 bp, Homo sapiens
  misc_feature: HIJSMM301CB7LR.12.1.A01.1.454.light.4.raw
atacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtgggtcccatcaaggttcagtggcagtgggtctggggacagatttcactctcaccatcagcagtctgcaacctgaagattctgcaacttattactgtcaacagagtaacagttaccctccactttcgcggaggaccgaagtggagatcaaacgaactgtgg

SEQ ID NO: 560806 - DNA, 377 bp, Homo sapiens; identical to SEQ ID NO: 536071
  misc_feature: HIJSMM301A1CH8.40.9.A09.1.454.light.4.raw

SEQ ID NO: 560807 - DNA, 502 bp, Homo sapiens
  misc_feature: HIJSMM301DYH1A.49.30.C08.1.454.light.4.raw
agtcgagagacacgaccggtgctcgatttagtctgacgtcaaagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcaggggacaacggtcacattggccatcagtggagtccaggcagaggacgaggctgactattattgtcaatcaacagacaccattggtacttatgtcttcggaactgcgaccaaggtcaccgtcctgggtcagcccaaggcccaaccccactgtcactctcg

SEQ ID NO: 560808 - DNA, 489 bp, Homo sapiens; identical to SEQ ID NO: 543840
  misc_feature: HIJSMM301CH927.12.88.H11.1.454.light.4.raw

SEQ ID NO: 560809 - DNA, 511 bp, Homo sapiens
  misc_feature: HIJSMM301CQ36D.43.9.A09.1.454.light.4.raw
tgtgagtagtcacgaccggtgctcgatttagcgagacgcgcaggggtctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggaactgtcaccagtggtcattatccctactggttccagcagaagcctggccaggccccccggacactgatttatggtgcgactaacaaacactcctggacccctgcccggttttcaggctccctcctcggggcaaagctgccctgacactgtcaggtgtgcagcctgaggacgaggctgactattactgcctgctcatatatggtggcgcgtgggtgttcggcggagggaccaagctgaccgtcctgggtcagcccaaggctgccccctcggtcactctgttcccgccctcctca

SEQ ID NO: 560810 - DNA, 498 bp, Homo sapiens; identical to SEQ ID NO: 536879
  misc_feature: HIJSMM301B8S99.22.14.B03.1.454.light.4.raw

SEQ ID NO: 560811 - DNA, 494 bp, Homo sapiens; identical to SEQ ID NO: 535276
  misc_feature: HIJSMM301CDT2Y.16.6.A06.1.454.light.4.raw

SEQ ID NO: 560812 - DNA, 494 bp, Homo sapiens; identical to SEQ ID NO: 534994
  misc_feature: HIJSMM301CVJMD.27.78.H01.1.454.light.4.raw

SEQ ID NO: 560813 - DNA, 500 bp, Homo sapiens; identical to SEQ ID NO: 542309
  misc_feature: HIJSMM301D2G4M.12.86.H09.1.454.light.4.raw

SEQ ID NO: 560814 - DNA, 493 bp, Homo sapiens
  misc_feature: HIJSMM301CDQ3U.27.78.H01.1.454.light.4.raw
agcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatgcctggaagctgaagatgctgcaacttattactgtcatcagagtactactttacctcaagtgatcaccttcggccaagggacacgactggagattaaacgaactgtggctgcaccatctgtt

SEQ ID NO: 560815 - DNA, 447 bp, Homo sapiens; identical to SEQ ID NO: 535020
  misc_feature: HIJSMM301AR9NK.18.9.A09.1.454.light.4.raw

SEQ ID NO: 560816 - DNA, 441 bp, Homo sapiens; identical to SEQ ID NO: 534971
  misc_feature: HIJSMM301AQW8N.11.3.A03.1.454.light.4.raw

SEQ ID NO: 560817 - DNA, 505 bp, Homo sapiens
  misc_feature: HIJSMM301COVZD.48.7.A07.1.454.light.4.raw
agtatacatacacgaccggtgctcgatttagcacgtgtcgcaagagagaggggagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccaggctcctcatctatggtgcgtccaccagggccactggcatcccagacaggttcagtggcagtgggtctgggacagacttcactctcaccatcaccagactggagcctgatgattttgcagtgtttttctgtcagcagtatggaagttcacctcggacattcggccaggggaccaaggtggaaatcaaacgaactgtggctgcaccatctgtcttcatcttccccg

SEQ ID NO: 560818 - DNA, 482 bp, Homo sapiens; identical to SEQ ID NO: 540658
  misc_feature: HIJSMM301CJ3SL.16.81.H04.1.454.light.4.raw

SEQ ID NO: 560819 - DNA, 484 bp, Homo sapiens
  misc_feature: HIJSMM301BVSW4.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccgggctgacgatgaggctgattattattgccagtcctatgacaacaccctgcgtggttttggctgttcggcggcgggaccaag

SEQ ID NO: 560820 - DNA, 509 bp, Homo sapiens
  misc_feature: HIJSMM301CGDX6.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcatcagcctggagcctgaagatgttgcagtttattactgtcaacatcgtaccgagtggcctccgggggccactttcggccctgggaccaaggtggagatcaaacgaactgtggctgcaccatctgtcttcatcttcccg

SEQ ID NO: 560821 - DNA, 513 bp, Homo sapiens
  misc_feature: HIJSMM301A2PX4.52.34.D01.1.454.light.4.raw
cgcagtacgacacgaccggtgctcgatttagatcgtctgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacattggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacagaaacacttgggtgttcggcggcgggaccaaactgaccgtcctacgtcagcccaaggctcgccccctcggtcactcttcg

SEQ ID NO: 560822 - DNA, 454 bp, Homo sapiens; identical to SEQ ID NO: 536347
  misc_feature: HIJSMM301B2W9X.19.86.H09.1.454.light.4.raw

SEQ ID NO: 560823 - DNA, 488 bp, Homo sapiens
  misc_feature: HIJSMM301ETKY3.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatctccccactttcggccctcggaccaaagtaggatatcaaacgaactagtggctgcaccatctgtt

SEQ ID NO: 560824 - DNA, 494 bp, Homo sapiens
  misc_feature: HIJSMM301BSQQ5.5.49.E05.1.454.light.4.raw
atcagacacgcacgaccggtgctcgatttagagcgactagcaacacacaaagggggctgctcagttaggacccagagggaaccatggaaaccccagcgcagcttctcttcctcctgctactctggctcccagataccgtcggagaagtcgtgttgacgcagtctccagacaccctgtctttgtctccaggggagagagccaccctctcctgcagggccagtgagagtcttggcggcagtcacttagcctggtaccagcaaaaacctggccaggctccccggctcctcatctatggtgcgtccaacagggccactgacaccccacgcagattcagcggcagtgggtctgggacagacttcactctcaccatcctcagagtggagcctgaagattttgcagtatattactgtcagcagtatggcttctcacctcacaatttcggcggcgggaccaaggtggagaccaaacgaactgtggctgcaccatctgtcttc

SEQ ID NO: 560825 - DNA, 503 bp, Homo sapiens
  misc_feature: HIJSMM301AT1T0.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgacctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggcccaaccca

SEQ ID NO: 560826 - DNA, 521 bp, Homo sapiens; identical to SEQ ID NO: 539470
  misc_feature: HIJSMM301BTJE0.27.23.C01.1.454.light.4.raw

SEQ ID NO: 560827 - DNA, 486 bp, Homo sapiens; identical to SEQ ID NO: 547345
  misc_feature: HIJSMM301A4FRE.47.78.H01.1.454.light.4.raw

SEQ ID NO: 560828 - DNA, 512 bp, Homo sapiens
  misc_feature: HIJSMM301BBIT3.17.62.F07.1.454.light.4.raw
cgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccgcctcctcctagtctacg

SEQ ID NO: 560829 - DNA, 479 bp, Homo sapiens; identical to SEQ ID NO: 535665
  misc_feature: HIJSMM301ATZIQ.12.10.A10.1.454.light.4.raw

SEQ ID NO: 560830 - DNA, 520 bp, Homo sapiens
  misc_feature: HIJSMM301B2606.27.23.C01.1.454.light.4.raw
agcgtcgtctcacgaccggtgctcgatttagtacacgtgattagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtccaggtcagcccagggctgcccctcggtcactctgttcccgccct

SEQ ID NO: 560831 - DNA, 447 bp, Homo sapiens; identical to SEQ ID NO: 535201
  misc_feature: HIJSMM301ECG4K.18.9.A09.1.454.light.4.raw

SEQ ID NO: 560832 - DNA, 476 bp, Homo sapiens; identical to SEQ ID NO: 538026
  misc_feature: HIJSMM301C8VHU.13.76.G10.1.454.light.4.raw

SEQ ID NO: 560833 - DNA, 508 bp, Homo sapiens; identical to SEQ ID NO: 536062
  misc_feature: HIJSMM301CHS0C.11.57.F02.1.454.light.4.raw

SEQ ID NO: 560834 - DNA, 457 bp, Homo sapiens; identical to SEQ ID NO: 546935
  misc_feature: HIJSMM301CZRX6.53.83.H06.1.454.light.4.raw

SEQ ID NO: 560835 - DNA, 489 bp, Homo sapiens
  misc_feature: HIJSMM301DC1IH.9.50.E06.1.454.light.4.raw
tgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaagggaccgaaacgtggacatcaagcgaactgtggctgcaccat

SEQ ID NO: 560836 - DNA, 504 bp, Homo sapiens; identical to SEQ ID NO: 535561
  misc_feature: HIJSMM301AFYOW.4.57.F02.1.454.light.4.raw

SEQ ID NO: 560837 - DNA, 516 bp, Homo sapiens
  misc_feature: HIJSMM301CR4YB.53.20.B09.1.454.light.4.raw
cgcgtatacacacgaccggtgctcgatttagtgtagtgtgaaggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggaaggacggccacgattacctgtgggggaaacaacattggaagtaaaagtgtgcactggtaccagcacaagccaggccaggcccctgcgctggtcgtctatgatgatagcgaccggccctcagggatccctgagcgattctctggctccaactctggggacacggccaccctgaccatcagcagggtcgaagccggggacgaggccgactattactgtcaggtgtgggattttaatagtgatcattgggtgttcggcggagggaccaagctgaccgtcctaggtcagcccaaggctgccccctcggtcactctgttcccaccctcctctcgta

SEQ ID NO: 560838 - DNA, 485 bp, Homo sapiens; identical to SEQ ID NO: 536040
  misc_feature: HIJSMM301CTWFI.15.1.A01.1.454.light.4.raw

SEQ ID NO: 560839 - DNA, 503 bp, Homo sapiens; identical to SEQ ID NO: 543003
  misc_feature: HIJSMM301EI2P9.13.37.D04.1.454.light.4.raw

SEQ ID NO: 560840 - DNA, 522 bp, Homo sapiens
  misc_feature: HIJSMM301BZS2Y.27.23.C01.1.454.light.4.raw
agcgtcgtctcacgaccggtgctcgatttagtacacgtgattagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctcgttccaccct

SEQ ID NO: 560841 - DNA, 501 bp, Homo sapiens
  misc_feature: HIJSMM301A0HO5.15.25.C03.1.454.light.4.raw
tctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcccgcaggtctagtcagagcctccagcatactgatggatacaactatttggattggtacctgcagaagccagggcagtctccacaactcctgatctatttgggttctaatcgggcctccggggtccctgacaggttcagtggcagtggatcaggcatagattttacactgaaaatcagcagagtggaggctgaggacgttggggtttattactgcatgcaaggtctacaaaccccgatcaccttcggccgagggacacgcctgagattaaacgaactgtggctgcaccatctgt

SEQ ID NO: 560842 - DNA, 476 bp, Homo sapiens; identical to SEQ ID NO: 547708
  misc_feature: HIJSMM301C57A1.12.1.A01.1.454.light.4.raw

SEQ ID NO: 560843 - DNA, 492 bp, Homo sapiens
  misc_feature: HIJSMM301BX0OG.19.57.F02.1.454.light.4.raw
tactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgcaacttatttttgtcaacaggctaacactttccccctcactttcggcggagggaccaaggtggaggatcaagcgaactgtggctgcaccatctgtctt

SEQ ID NO: 560844 - DNA, 492 bp, Homo sapiens
  misc_feature: HIJSMM301CNE8K.52.52.E08.1.454.light.4.raw
cgcagtacgacacgaccggtgctcgatttagtcgagctctcagagagaaaggggtgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgcacacagtgatggaaacacctacttgaattggtttcagcagaggccaggccaatctccaaggcgcctaatttataaggtttctcaccgggactctggggtcccagacagattcagcggcagtgggtcaggcactgatttcacgctgaaaatcagcagggtggaggctgaagatgttggggtttattactgcatgcaaggcacacactggcctgcgtacacttttggccaggggaccaagctggagaggaaacgaactgt

SEQ ID NO: 560845 - DNA, 416 bp, Homo sapiens; identical to SEQ ID NO: 536892
  misc_feature: HIJSMM301EB363.16.46.E02.1.454.light.4.raw

SEQ ID NO: 560846 - DNA, 501 bp, Homo sapiens
  misc_feature: HIJSMM301BWIIY.17.27.C05.1.454.light.4.raw
cgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtcatttatggtaagaataaccggccctcagggatcccagaccgattctctggctccgactcaggaaagacagcttccctgaccatcactggggctcaggcggaagatgaggctgactattactgtaactcccgggacagcagtgctgaccaggtggtattcggcggagggacccacctgaccgtcttaagtcagcccaaggctgccccctcggtca

SEQ ID NO: 560847 - DNA, 480 bp, Homo sapiens; identical to SEQ ID NO: 535442
  misc_feature: HIJSMM301BB9JY.41.17.B06.1.454.light.4.raw

SEQ ID NO: 560848 - DNA, 521 bp, Homo sapiens
  misc_feature: HIJSMM301D0LHE.48.27.C05.1.454.light.4.raw
  modified_base (512)..(512): a, c, t, g, unknown or other
agtatacatacacgaccggtgctcgatttagacgcgatcgaagggtttggggggtagagaagacaggattcaggacaatctccagcatggccggcttccctctcctcctcaccctcctcactcactgtgcagggtcctgggcccagtctgtgttgactcagccaccctcaacgtctgggactcccgggcagaccgtcaccatctcttgttctggcagcagatggaacatcgggagcaattttgttcactggtaccagcaactgccaggagcggcccccaaactcctcatctacaggaatgataagcgaccctcaggggtccctgcccgattctctggctccaagtctggcaccacagcctccctggccatcagaggactccggtccgaggatgagggtgatttttattgtgctgtttgggatgacgacatgaatggttcgattttcggcggagggaccaaactgaccgtcctgggtcagcccaaggctgccccctcggtcactctgttcccnccctcctct

SEQ ID NO: 560849 - DNA, 494 bp, Homo sapiens; identical to SEQ ID NO: 534992
  misc_feature: HIJSMM301D6Q87.9.1.A01.1.454.light.4.raw

SEQ ID NO: 560850 - DNA, 500 bp, Homo sapiens
  misc_feature: HIJSMM301DOBHP.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcgagggaccaagctgaccgtcctgcgtcagcccaaggctgccccctcggtcact

SEQ ID NO: 560851 - DNA, 494 bp, Homo sapiens; identical to SEQ ID NO: 535629
  misc_feature: HIJSMM301DPU2L.4.27.C05.1.454.light.4.raw

SEQ ID NO: 560852 - DNA, 493 bp, Homo sapiens
  misc_feature: HIJSMM301CO2QN.51.6.A06.1.454.light.4.raw
cgatcgtatacacgaccggtgctcgatttagatctactgacagggggtgggtccaggaggcagaactctgggtgtctcaccatggccaggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgattctctggctccacctcagggacaatggtcacattgaccatcagtggagtccaggcagaagacgaggctgactatttctgtcaatcttcagacatcagtggtacttatgtcttcggaactgggaccaaggtcaccgtcctaggtcagcccaaggccaaccccactgtcactctcg

SEQ ID NO: 560853 - DNA, 441 bp, Homo sapiens; identical to SEQ ID NO: 534971
  misc_feature: HIJSMM301EHHIM.11.3.A03.1.454.light.4.raw

SEQ ID NO: 560854 - DNA, 501 bp, Homo sapiens; identical to SEQ ID NO: 536867
  misc_feature: HIJSMM301BLTOH.5.86.H09.1.454.light.4.raw

SEQ ID NO: 560855 - DNA, 501 bp, Homo sapiens; identical to SEQ ID NO: 550139
  misc_feature: HIJSMM301AXHST.15.56.F01.1.454.light.4.raw

SEQ ID NO: 560856 - DNA, 483 bp, Homo sapiens
  misc_feature: HIJSMM301CB817.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtgggtcccatcaaggttcagtggcgccggatctgggacagaattcactctcaccatcagcgggctccagtctgaggactctgcaacttattactgccaacaatatgatattattctccagcgttcggccaggggaccaaggtgaagtcaagcgaactgtggctgcaccatct

SEQ ID NO: 560857 - DNA, 484 bp, Homo sapiens; identical to SEQ ID NO: 550098
  misc_feature: HIJSMM301A0TAE.26.78.H01.1.454.light.4.raw

SEQ ID NO: 560858 - DNA, 477 bp, Homo sapiens
  misc_feature: HIJSMM301BUSN5.51.67.G01.1.454.light.4.raw
cgatcgtatacacgaccggtgctcgatttagagtatacatattgggtttgggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattactgtcaacagtatgatagtctcccgctcactttcggcggggggaccaaggtggagatcaagcgaactgt

SEQ ID NO: 560859 - DNA, 514 bp, Homo sapiens
  misc_feature: HIJSMM301CNTPO.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctccccccggacgttcggtccaacgggaccgaacggtaggaaagtacaagacgaactagtggctgcaccactctgtcttctatcttcccgt

SEQ ID NO: 560860 - DNA, 495 bp, Homo sapiens; identical to SEQ ID NO: 535486
  misc_feature: HIJSMM301CXCG9.26.72.G06.1.454.light.4.raw

SEQ ID NO: 560861 - DNA, 497 bp, Homo sapiens; identical to SEQ ID NO: 535286
  misc_feature: HIJSMM301B4XRX.18.59.F04.1.454.light.4.raw

SEQ ID NO: 560862 - DNA, 534 bp, Homo sapiens
  misc_feature: HIJSMM301AUWWE.49.87.H10.1.454.light.4.raw
agtcgagagacacgaccggtgctcgatttagcagtactgcgttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttcgtcatcgcttctccggctccaagtctggcagcacggcctccctgaccatctctgggctccaggctgaggacgaggctgattattactgcagctcatatacaaacataaacaacttggtggttcggtcggcgggaccgaaacctagaccggtcctaaccgtcctagcccaacggactgccccctccggtccgtactcttccg

SEQ ID NO: 560863 - DNA, 477 bp, Homo sapiens; identical to SEQ ID NO: 559307
  misc_feature: HIJSMM301CZIH3.43.13.B02.1.454.light.4.raw

SEQ ID NO: 560864 - DNA, 502 bp, Homo sapiens
  misc_feature: HIJSMM301DN82G.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctaattattactgcagctcatatacaggcacagcactctctatgtcttcggaactgggaccaaggtccaccgtcctaggtcacgcccaaggccaa

SEQ ID NO: 560865 - DNA, 514 bp, Homo sapiens
  misc_feature: HIJSMM301DANLQ.48.23.C01.1.454.light.4.raw
agtatacatacacgaccggtgctcgatttagtacacgtgattagggattggggagcttcagctgtggtagagaagacaggattcaggacaatctccagcatggccggcttccctctcctcctcaccctcctcactcactgtgcagggtcctgggcccagtctgtgttgactcagccaccctcaacgtctgggactcccgggcagaccgtcaccatctcttgttctggcagcagatggaacatcgggagcaattttgttcactggtaccagcaactgccaggagcggcccccaaactcctcatctacaggaatgataagcgaccctcaggggtccctgcccgattctctggctccaagtctggcaccacagcctccctggccatcagaggactccggtccgaggatgagggtgatttttattgtgctgtttgggatgacgacatgaatggttcgattttcggcggagggaccaaactgaccgtctgggtcagcccaaggctgccccctggtctac

SEQ ID NO: 560866 - DNA, 484 bp, Homo sapiens; identical to SEQ ID NO: 535240
  misc_feature: HIJSMM301EI72J.47.60.F05.1.454.light.4.raw

SEQ ID NO: 560867 - DNA, 488 bp, Homo sapiens; identical to SEQ ID NO: 535990
  misc_feature: HIJSMM301DH2SU.11.28.C06.1.454.light.4.raw

SEQ ID NO: 560868 - DNA, 504 bp, Homo sapiens
  misc_feature: HIJSMM301D6DH5.8.1.A01.1.454.light.4.raw
ctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgaattgccaaagaaatatgcttattggtaccagcagaagtcaggccaggcccctgtcctggtcatttatgaggacaagaaacgaccctccgggatccctgacagactctctggctccagctcagggacagtggccaccttgactatcactggggcccaggtggaggatgaaggagactactattgttactctccagagaaggatggtcatcattgggtgttcggcggagggaccaagctgaccgtcctaagtcagcccaaggctgccccctcggtcactctgttcccacct

SEQ ID NO: 560869 - DNA, 512 bp, Homo sapiens; identical to SEQ ID NO: 542831
  misc_feature: HIJSMM301CAL7Y.43.19.B08.1.454.light.4.raw

SEQ ID NO: 560870 - DNA, 494 bp, Homo sapiens; identical to SEQ ID NO: 558792
  misc_feature: HIJSMM301BGFZH.10.79.H02.1.454.light.4.raw

SEQ ID NO: 560871 - DNA, 484 bp, Homo sapiens
  misc_feature: HIJSMM301CQEDK.17.39.D06.1.454.light.4.raw
cgtagactagcacgaccggtgctcgatttagtgacatctcgcagttctttgggggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttggcagcaacttagcctggtatcagcagaaacctggccaggctcccaggctcctcatgtatggtgcatctaccagggccactggtgtcccagccaggttcagtggcagtgggtctgggacagagttctctctcatcatcagcagcctgcagtctgaagattttgcggtttattactgtcagcagtataatcagtggcctccgtggacgttcggccaagggaccaaggtaggaaatcaaacgaactgtgg

SEQ ID NO: 560872 - DNA, 484 bp, Homo sapiens; identical to SEQ ID NO: 538367
  misc_feature: HIJSMM301AMZA5.8.14.B03.1.454.light.4.raw

SEQ ID NO: 560873 - DNA, 486 bp, Homo sapiens; identical to SEQ ID NO: 535043
  misc_feature: HIJSMM301EQGVQ.46.35.D02.1.454.light.4.raw

SEQ ID NO: 560874 - DNA, 512 bp, Homo sapiens
  misc_feature: HIJSMM301CDHO7.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgtccacggaccgaaggtaggaagtacaaacgaactagtggcgtgcaccactctgtcttctatcttcccgtcccact

SEQ ID NO: 560875 - DNA, 472 bp, Homo sapiens
  misc_feature: HIJSMM301B50DT.15.8.A08.1.454.light.4.raw
  modified_base (346)..(346): a, c, t, g, unknown or other
tctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtatcccagccaggttcagtggcagtgggtctggcacagagttcactctcaccatcagcagcccgnagtctgaagattttgcagtttattactgtcagcaatataacaagtggccattcactttcggcccagggaccaaagtggatatcaaacgaactgtggctgcaccatctgtcttcatcttcccgccat

SEQ ID NO: 560876 - DNA, 444 bp, Homo sapiens; identical to SEQ ID NO: 537971
  misc_feature: HIJSMM301CEUXX.2.76.G10.1.454.light.4.raw

SEQ ID NO: 560877 - DNA, 447 bp, Homo sapiens; identical to SEQ ID NO: 535020
  misc_feature: HIJSMM301CMLGS.18.9.A09.1.454.light.4.raw

SEQ ID NO: 560878 - DNA, 502 bp, Homo sapiens
  misc_feature: HIJSMM301CKCIE.40.9.A09.1.454.light.4.raw
tctagcgactcacgaccggtgctcgatttagcgagacgcgcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcaccatcagcggcctgcaggctgaagatgtggcagtttattactgtcagcactgttttggcggttctccgactttcggcggagggaccaaggtggaggtcaaacgaactgtggctgcaccatctgtcttctatcttcccgccatctgaagtcg

SEQ ID NO: 560879 - DNA, 503 bp, Homo sapiens
  misc_feature: HIJSMM301A9Z0T.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggtccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactggaccgtcctaggtcagcccaa

SEQ ID NO: 560880 - DNA, 491 bp, Homo sapiens
  misc_feature: HIJSMM301CWRAQ.16.68.G02.1.454.light.4.raw
tgtactactccacgaccggtgctcgatttagtcgatagtgaagggaaagggggagtcagacccagtcaggacacagccatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggatagaattcactctcactatcaccagcctgcaacctgatgattttgcaattattactgccaacagtatcatcatcattgtaatttcggtggagggaccaaggtggaggtcaaacgaactgtggctgcaccatctgtcttcatt

SEQ ID NO: 560881 - DNA, 447 bp, Homo sapiens; identical to SEQ ID NO: 535020
  misc_feature: HIJSMM301A4Z06.18.9.A09.1.454.light.4.raw

SEQ ID NO: 560882 - DNA, 473 bp, Homo sapiens; identical to SEQ ID NO: 535262
  misc_feature: HIJSMM301CV11J.8.67.G01.1.454.light.4.raw

SEQ ID NO: 560883 - DNA, 486 bp, Homo sapiens; identical to SEQ ID NO: 537617
  misc_feature: HIJSMM301DWJ32.10.53.E09.1.454.light.4.raw

SEQ ID NO: 560884 - DNA, 486 bp, Homo sapiens
  misc_feature: HIJSMM301CE1F8.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagattttcactctcaccatcaatcacctgcaggctgaggattttgcaacttactactgtcagcaggctaacaggctgcccccaaccttcggccaggggacacgactggagattaaacgaactgtgctgcaccatctgtt

SEQ ID NO: 560885 - DNA, 422 bp, Homo sapiens; identical to SEQ ID NO: 537797
  misc_feature: HIJSMM301ECMX1.9.34.D01.1.454.light.4.raw

SEQ ID NO: 560886 - DNA, 494 bp, Homo sapiens; identical to SEQ ID NO: 534992
  misc_feature: HIJSMM301AZIFB.9.1.A01.1.454.light.4.raw

SEQ ID NO: 560887 - DNA, 489 bp, Homo sapiens; identical to SEQ ID NO: 535139
  misc_feature: HIJSMM301CA5VT.14.55.E11.1.454.light.4.raw

SEQ ID NO: 560888 - DNA, 485 bp, Homo sapiens; identical to SEQ ID NO: 535880
  misc_feature: HIJSMM301AR1XO.7.75.G09.1.454.light.4.raw

SEQ ID NO: 560889 - DNA, 507 bp, Homo sapiens; identical to SEQ ID NO: 543767
  misc_feature: HIJSMM301EQOWP.21.87.H10.1.454.light.4.raw

SEQ ID NO: 560890 - DNA, 488 bp, Homo sapiens; identical to SEQ ID NO: 535990
  misc_feature: HIJSMM301CD25S.11.28.C06.1.454.light.4.raw

SEQ ID NO: 560891 - DNA, 434 bp, Homo sapiens; identical to SEQ ID NO: 535153
  misc_feature: HIJSMM301CK9Q1.18.5.A05.1.454.light.4.raw

SEQ ID NO: 560892 - DNA, 514 bp, Homo sapiens
  misc_feature: HIJSMM301A7485.17.2.A02.1.454.light.4.raw
cgtagactagcacgaccggtgctcgatttagactcatctacagggggggtagagaagacaggactcaggacaatctccagcatggccagcttccctctcctcctcaccctcctcactcactgtgcagggtcctgggcccagtctgtactgactcagccaccctcagcgtctgggacccccggacagagggtcaccatctcttgttctggaagcagctccaacatcgggactaatactgtaacctggttccagcacgtcccaggaacggcccccaaactcgtcatgtataattatagtcagcggccctcaggggtccctgaccgattcgctggctccaactctggcacctcagcctccctggccatcagtgggctccagtctgaggatgaggctgattattactgtgcagcatgggatgccagcctgagtagtcccgtcttcggaactgggaccaaggtcaccgtcctacgtcagcccaaggccaacccccactcgtcactctgttccccaccct

SEQ ID NO: 560893 - DNA, 504 bp, Homo sapiens; identical to SEQ ID NO: 539175
  misc_feature: HIJSMM301EKFZE.48.53.E09.1.454.light.4.raw

SEQ ID NO: 560894 - DNA, 493 bp, Homo sapiens
  misc_feature: HIJSMM301C9R2R.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccctcggtcactctgttcccaccctccctcgagtcg

SEQ ID NO: 560895 - DNA, 500 bp, Homo sapiens
  misc_feature: HIJSMM301DGW3S.43.62.F07.1.454.light.4.raw
tgtgagtagtcacgaccggtgctcgatttagtagtcgcataaagggaaagggggcaggagtcagtctcagtcaggacacagcatggacatgagggtccccgctcagctcctggggctcctgctactctggctccgaggtgccagatgtgacatccagttgacgcagtctccatcctccctgtctgcatctgtgggagacagactcaccatcacttgccgggcaagtcagaccattaggacctatttaaattggtatcaggagaacccagggaaagcccctaagctcctgatctatgctacttccactttgcaaagtggggtcccatctaggttcagtggcagtggatcggggacacatttcactctcaccatcagtagtctgcaacctgaagattatgcaacttacttctgtcaacagagtgacagaaacccgtggacgttcggccaagggaccaaggtggaaaggcaaacgaactagtggctgcaccatctgtcttcta

SEQ ID NO: 560896 - DNA, 488 bp, Homo sapiens; identical to SEQ ID NO: 535081
  misc_feature: HIJSMM301B4CP9.26.23.C01.1.454.light.4.raw

SEQ ID NO: 560897 - DNA, 494 bp, Homo sapiens
  misc_feature: HIJSMM301AVKY2.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaatgatcaccttcggccaagggacacgactggagattaaacgaactagtggctgcaccatctgtctt

SEQ ID NO: 560898 - DNA, 476 bp, Homo sapiens; identical to SEQ ID NO: 538026
  misc_feature: HIJSMM301CIX6S.13.76.G10.1.454.light.4.raw

SEQ ID NO: 560899 - DNA, 492 bp, Homo sapiens; identical to SEQ ID NO: 544236
  misc_feature: HIJSMM301CR663.12.23.C01.1.454.light.4.raw

SEQ ID NO: 560900 - DNA, 507 bp, Homo sapiens; identical to SEQ ID NO: 535641
  misc_feature: HIJSMM301D7CEQ.10.88.H11.1.454.light.4.raw

SEQ ID NO: 560901 - DNA, 491 bp, Homo sapiens
  misc_feature: HIJSMM301DMSKP.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaagggaccaaagtggacgatcaagcgaactgtggctgcaccatctgt

SEQ ID NO: 560902 - DNA, 516 bp, Homo sapiens
  misc_feature: HIJSMM301DNNUV.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggtccgaacggaccgaacggtaggaaggtacgaaacgaactagtggcgtgcaccatctgtcttcatcttcccgccact

SEQ ID NO: 560903 - DNA, 444 bp, Homo sapiens; identical to SEQ ID NO: 535192
  misc_feature: HIJSMM301CNZ1C.5.9.A09.1.454.light.4.raw

SEQ ID NO: 560904 - DNA, 523 bp, Homo sapiens
  misc_feature: HIJSMM301ANN9C.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtggttcggcggagggaccaggctgaccggtcctaggtcagcccaaggctgccccctcggtcactctgttcccaccct

SEQ ID NO: 560905 - DNA, 491 bp, Homo sapiens
  misc_feature: HIJSMM301ASP51.26.12.B01.1.454.light.4.raw
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtatcccggccagattcagtggcagggggtctgggacagaattcactctcaccatcaccagcctgcagtctgaagattttgcagtctattactgtcagcaatataattactggctctctttcgcgggggaccaagctgagatcaaccgaactgtggctgcaccatctgt

SEQ ID NO: 560906 - DNA, 494 bp, Homo sapiens; identical to SEQ ID NO: 534994
  misc_feature: HIJSMM301C5NFL.27.78.H01.1.454.light.4.raw

SEQ ID NO: 560907 - DNA, 508 bp, Homo sapiens
  misc_feature: HIJSMM301D8JFH.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccgggggccacttttggccctgggaccaaagtggatatcaaacgaactgtggctgcaccatctgtcttcta

SEQ ID NO: 560908 - DNA, 493 bp, Homo sapiens; identical to SEQ ID NO: 541489
  misc_feature: HIJSMM301EBR0V.12.23.C01.1.454.light.4.raw

SEQ ID NO: 560909 - DNA, 476 bp, Homo sapiens
  misc_feature: HIJSMM301A5G78.43.35.D02.1.454.light.4.raw
tgtgagtagtcacgaccggtgctcgatttagcacacgatagttgggtttggggaaacagagcttcagcaagcatagtgggaatctgcaccatgccctgggctctgctcctcctgaccctcctcactcactctgcagtgtcagtggtccaggcagggctgactcagccaccctcggtgtccaagggcttgagacagaccgccacactcacctgcactgggaacagcaacaatgttggcaaccaaggagcagcttggctgcagcagcaccagggccaccctcccaaactcctatcctacaggaataacaaccggccctcagggatctcagagagattatctgcatccaggtcaggaaacacagcctccctgaccattactggactccagcctgaggacgaggctgactattactgctcagcatgggacagcagcctcagtgcttgggtgttcggcggagggaccaagctgaccgtcct

SEQ ID NO: 560910 - DNA, 502 bp, Homo sapiens
  misc_feature: HIJSMM301CWEZ6.10.36.D03.1.454.light.4.raw
catagtagtgcacgaccggtgctcgatttagctgcgtcacgatctctcttggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaatgtcgggagagataatgtgtactggtaccagcaggtcccaggaaccggcccccaaactcctcatctataacgattatcggcggccctcaggggtccctgaccgattctctggctccaagtctggcacctcagcctccctggccatcagtgggctccggtccgaggatgacgctgattattactgtgtagcatgggatgacagcctgagtgcttatgtcttcggaactgggaccaaggtcaccgtcctacgtcagcccaaggccaaccccactgtcta

SEQ ID NO: 560911 - DNA, 488 bp, Homo sapiens; identical to SEQ ID NO: 545567
  misc_feature: HIJSMM301BGUSI.47.38.D05.1.454.light.4.raw

SEQ ID NO: 560912 - DNA, 490 bp, Homo sapiens
  misc_feature: HIJSMM301BHEQH.41.25.C03.1.454.light.4.raw
tctatactatcacgaccggtgctcgatttagtagtgtagatttgggtttgggggaactgctcagttaggacccagacggaaccatggaagccccagcgcagcttctcttcctcctgctactctggctcccagataccactgcagaaatactgatgacgcagtctccagccaccctgtctgtgtctccaggagaaagagtcaccctctcctgcagggccagtcagagtgctggcagcaacttagcctggtatcagcagaaacctggccaggctcccaggctcctcatctctggtgcttccacccgggacactggtatcccagccaggttcagtggcagtgggtctgggacagagttcactctcaccatcagcactctacagtctgaggattatgcagtttactactgtctgcagtataaagactggcctagggtcactttcggccctgggaccaaagtggatttcaaacgaactgtggctgcaccatctgt

SEQ ID NO: 560913 - DNA, 453 bp, Homo sapiens; identical to SEQ ID NO: 544521
  misc_feature: HIJSMM301DZ4MA.19.86.H09.1.454.light.4.raw

SEQ ID NO: 560914 - DNA, 489 bp, Homo sapiens
  misc_feature: HIJSMM301EY44G.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagattttcactctcaccgtcagcagtctgcaacctgaagattttgcaacttactactgtcaacagagttacagtacccccctcactttcggcggagggaccaaggcggagatcagacgaactgtggctgcaccatctgtcttca

SEQ ID NO: 560915 - DNA, 519 bp, Homo sapiens
  misc_feature: HIJSMM301B41NW.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgcccctcggtcactctgttcccacct

SEQ ID NO: 560916 - DNA, 492 bp, Homo sapiens
  misc_feature: HIJSMM301BW0SU.51.81.H04.1.454.light.4.raw
  modified_base (459)..(459): a, c, t, g, unknown or other
cgatcgtatacacgaccggtgctcgatttagtagtgtagattcgcggggtgggtccaggaggcagaactctgggtgtctcaccatggcctggatccctctacttctccccctctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaaccattggtacttatgtcttcggaactgcgacaaggtcaccgtccnggtcagcccaaggccaacccactgtcactctcg

SEQ ID NO: 560917 - DNA, 488 bp, Homo sapiens; identical to SEQ ID NO: 539612
  misc_feature: HIJSMM301AT58V.3.55.E11.1.454.light.4.raw

SEQ ID NO: 560918 - DNA, 506 bp, Homo sapiens
  misc_feature: HIJSMM301BY6A1.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtggaaagtcaaacgaactagtggcgtgcaccatctgtcttctatcttccccg

SEQ ID NO: 560919 - DNA, 516 bp, Homo sapiens; identical to SEQ ID NO: 552129
  misc_feature: HIJSMM301B2FY3.27.23.C01.1.454.light.4.raw

SEQ ID NO: 560920 - DNA, 515 bp, Homo sapiens
  misc_feature: HIJSMM301C271L.40.12.B01.1.454.light.4.raw
tctagcgactcacgaccggtgctcgatttagtagtgtagattccgcggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaactacacccaggcaaagcccccaaactcatgatttctgacgtcagtaagcggccctcaggggtccctgatcgcttctctggctccaagtctggcaacacggcctccctgaccgtctctgggctccaggctgaagatgaggctgattattactgctactcgtatgcaggcggcaacaatttgggtcttcggcggagggaccaagctgaccgtcctaggtcagcccaaggctgccccctcggtcactctgttccca

SEQ ID NO: 560921 - DNA, 485 bp, Homo sapiens
  misc_feature: HIJSMM301BLG6W.22.77.G11.1.454.light.4.raw
acatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtctccatcctcccggtctgcatctgttggagaaagaatcaccatcacttgtcgggcaagtcagagcattgatatccttttaaactggtatcatcagagaccagggaaggcccctaagttcctgatccatgatgcatccactctgcagagtggagtcccatccaggttcagtggcagtgggtctgggacagagttcactctcaccatcaacagtctgcagccagaggactttggaacctactattgccaacagacttacacgtacccccccacgttcggcggacggaccacagtcgagatacaaacgaactgtggctgcaccat

SEQ ID NO: 560922 - DNA, 501 bp, Homo sapiens; identical to SEQ ID NO: 535746
  misc_feature: HIJSMM301COJJY.18.11.A11.1.454.light.4.raw

SEQ ID NO: 560923 - DNA, 507 bp, Homo sapiens
  misc_feature: HIJSMM301BIM7M.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtggaaagtacaaacgaactagtggctgcaccactctgtcttctatcttccccg

SEQ ID NO: 560924 - DNA, 488 bp, Homo sapiens; identical to SEQ ID NO: 537260
  misc_feature: HIJSMM301B4VNW.47.70.G04.1.454.light.4.raw

SEQ ID NO: 560925 - DNA, 517 bp, Homo sapiens
  misc_feature: HIJSMM301EG3VY.17.33.C11.1.454.light.4.raw
cgtagactagcacgaccggtgctcgatttagagtgagctcgttgggtttgggggcgccaggggtcccgttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctcgccccctcggtcacctctgttccccaccctcct

SEQ ID NO: 560926 - DNA, 513 bp, Homo sapiens; identical to SEQ ID NO: 541387
  misc_feature: HIJSMM301CKVHQ.17.33.C11.1.454.light.4.raw

SEQ ID NO: 560927 - DNA, 495 bp, Homo sapiens
  misc_feature: HIJSMM301B8RMX.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgagattttgcggtttattactgtcagcagtataataactggcctccacggtacacttttggccaggggaccaagctggagatcaaacgaactgtggctgcaccatctgt

SEQ ID NO: 560928 - DNA, 499 bp, Homo sapiens
  misc_feature: HIJSMM301CFK0O.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggcggagggaccagggtggagatcaaacgaactgtggctgcaccatctgtcttcatttccccg

SEQ ID NO: 560929 - DNA, 494 bp, Homo sapiens
  misc_feature: HIJSMM301DJ84G.19.83.H06.1.454.light.4.raw
tactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcaggcacagattttacactgaaaatcaacagagtggaggctgaggatgttggggtttattactgcatgcaagctctacaaactccctcaacgttcggcggagggaccaaaggtggagatcaaacgaactgtggctgcaccatctgtcttcta

SEQ ID NO: 560930 - DNA, 518 bp, Homo sapiens
  misc_feature: HIJSMM301EIELU.15.34.D01.1.454.light.4.raw
tctacgtagccacgaccggtgctcgatttagatcgtctgtgttgggtttgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtggggcgtggcatttgggtgttcggcggagggaccaaactgaccgtcctaggtcag

SEQ ID NO: 560931 - DNA, 501 bp, Homo sapiens
  misc_feature: HIJSMM301B3DHQ.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaaccctac

SEQ ID NO: 560932 - DNA, 502 bp, Homo sapiens; identical to SEQ ID NO: 554952
  misc_feature: HIJSMM301C9NDJ.43.62.F07.1.454.light.4.raw

SEQ ID NO: 560933 - DNA, 490 bp, Homo sapiens; identical to SEQ ID NO: 541567
  misc_feature: HIJSMM301COHNM.22.65.F10.1.454.light.4.raw

SEQ ID NO: 560934 - DNA, 503 bp, Homo sapiens; identical to SEQ ID NO: 537841
  misc_feature: HIJSMM301CBNDP.48.71.G05.1.454.light.4.raw

SEQ ID NO: 560935 - DNA, 492 bp, Homo sapiens
  misc_feature: HIJSMM301B2NUY.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcgcggagggaccgagggtggagatcaaacgaactgtggctgcaccatctgtcttcat

SEQ ID NO: 560936 - DNA, 466 bp, Homo sapiens; identical to SEQ ID NO: 535366
  misc_feature: HIJSMM301DVBEA.13.4.A04.1.454.light.4.raw

SEQ ID NO: 560937 - DNA, 478 bp, Homo sapiens
  misc_feature: HIJSMM301CAWG5.40.59.F04.1.454.light.4.raw
tctagcgactcacgaccggtgctcgatttagtacacacacttagggattggggggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagcccaagg

SEQ ID NO: 560938 - DNA, 486 bp, Homo sapiens; identical to SEQ ID NO: 535917
  misc_feature: HIJSMM301EYEW9.3.10.A10.1.454.light.4.raw

SEQ ID NO: 560939 - DNA, 491 bp, Homo sapiens; identical to SEQ ID NO: 536211
  misc_feature: HIJSMM301EECYA.16.53.E09.1.454.light.4.raw

SEQ ID NO: 560940 - DNA, 488 bp, Homo sapiens; identical to SEQ ID NO: 535081
  misc_feature: HIJSMM301AX4CQ.26.23.C01.1.454.light.4.raw

SEQ ID NO: 560941 - DNA, 492 bp, Homo sapiens; identical to SEQ ID NO: 557028
  misc_feature: HIJSMM301DAMLY.51.6.A06.1.454.light.4.raw

SEQ ID NO: 560942 - DNA, 497 bp, Homo sapiens; identical to SEQ ID NO: 536376
  misc_feature: HIJSMM301AITJ0.22.9.A09.1.454.light.4.raw

SEQ ID NO: 560943 - DNA, 495 bp, Homo sapiens
  misc_feature: HIJSMM301BZD03.18.11.A11.1.454.light.4.raw
  modified_base (443)..(443): a, c, t, g, unknown or other
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaaacctgcaggctgaagatgtggcagtttattactgtcagcaatactatagtcctcctctcacgttcggcggagggaccaaggnggaggatcaaacgaaactgtgctgcaccatctgtcttcatctcccgtccact

SEQ ID NO: 560944 - DNA, 447 bp, Homo sapiens; identical to SEQ ID NO: 535020
  misc_feature: HIJSMM301DBSMK.18.9.A09.1.454.light.4.raw

SEQ ID NO: 560945 - DNA, 482 bp, Homo sapiens
  misc_feature: HIJSMM301AT3MH.13.8.A08.1.454.light.4.raw
tcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggcaagtcagaccattgacaaatatgtaaattggtatcaacagaagccaggtgaagcccctaagctcctgatctatactgcatccactttgtcaggcggggtcccatcaaggttccgtggcagtggatctgggacagatttcactctcaccatcaccagtctgcaacctgaagactgtgcaacttactactgccaacagtcttacggaacctcgtacacttttggccaggggaccaggctggagatcaaacgaactgtggctgcaccatctgt

SEQ ID NO: 560946 - DNA, 487 bp, Homo sapiens
  misc_feature: HIJSMM301DOCWC.26.37.D04.1.454.light.4.raw
agactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagcctggtaccagcagacacctgggcagactcccaggctcctcatttatgctgcatccaccagggccactggtatcccagccaggttcagtggcagtgggtctgggacagagttcactctcaccatcagcagctgcagtctgaagattgtgcaatttattactgtcagcaatataatacctggcctccgctcactttcggcggagggaccaaggttgagatacaaacgaactgtggctgcacc

SEQ ID NO: 560947 - DNA, 486 bp, Homo sapiens; identical to SEQ ID NO: 535043
  misc_feature: HIJSMM301BWYC7.46.35.D02.1.454.light.4.raw

SEQ ID NO: 560948 - DNA, 503 bp, Homo sapiens
  misc_feature: HIJSMM301CND4B.40.33.C11.1.454.light.4.raw
tctagcgactcacgaccggtgctcgatttagagtgagctcgttgggtttggggggaagcctgagaacacttagccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagaccccaggccagcctccacgttcactcatcgtcagcacaagcagacgtttgcctggggtgcctgatcgcttctctgcctccatccttgggaacaaagctgccctcaccattacgggggcccagccagaggatgagtcttattattactgcatgctccatgtgggggtgccgacttgggtgttcggcggagggaccaagctgaccgtcctaggtcagcccaaggctgccccctc

SEQ ID NO: 560949 - DNA, 520 bp, Homo sapiens; identical to SEQ ID NO: 535773
  misc_feature: HIJSMM301C6L9Z.41.19.B08.1.454.light.4.raw

SEQ ID NO: 560950 - DNA, 475 bp, Homo sapiens
  misc_feature: HIJSMM301EFFLU.5.12.B01.1.454.light.4.raw
atcagacacgcacgaccggtgctcgatttagtagtgtagattccgcggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaacagtgacattggtgcttatgactatgtctcgtggtatcaaaagtatccagacacagcccccaaactcatcctttatgatgtccgtgttcggccctcaggggtttctgttcgcttctctggctccaagtctggcagcacggcctccctgaccatctctgggctccaggctgaggacgaggctgactattattgcagttcatatggtagtatgaagactcttgtgattttcggcggagggaccaagctgaccgt

SEQ ID NO: 560951 - DNA, 494 bp, Homo sapiens; identical to SEQ ID NO: 534994
  misc_feature: HIJSMM301DTWUN.27.78.H01.1.454.light.4.raw

SEQ ID NO: 560952 - DNA, 484 bp, Homo sapiens
  misc_feature: HIJSMM301DMKG9.47.60.F05.1.454.light.4.raw
agctcacgtacacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgcagtttattactgtcagcagtatcatgactggccgctcaccttaggccaagggacacgactggagattaaacgaactgtggctgcaccat

SEQ ID NO: 560953 - DNA, 479 bp, Homo sapiens
  misc_feature: HIJSMM301B01W5.43.81.H04.1.454.light.4.raw
tgtgagtagtcacgaccggtgctcgatttagtagtgtagattcgcggggggagtcagacccagtcaggacacagcatggacatgagggtccccgctcagctcctggggctcctgctgctctggttcccaggttccagatgcgacatccagctgacccagtctccatcttctgtgtctgcatctgtgggagacacagtcaccatcacttgtcgggcgagtcaagttattagtaactggttagcctggtatcagcagaaaccaggaaaagcccctaaactcctgatctatgctgcatccaggttgcagagtggggtcccatcaagattcagcggcagtggatctgggacagatttcactctcactatcagcagcctgcagcctgaagattttgccacttactattgtcaacaggctgacagtttccccttcaccttcggccaagggacacgactggacattaaacgaactgtggctgcacc

SEQ ID NO: 560954 - DNA, 504 bp, Homo sapiens
  misc_feature: HIJSMM301C4BLY.14.3.A03.1.454.light.4.raw
cgtctagtaccacgaccggtgctcgatttagagagcgtcacagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctggtaccaacagcacccaggcaaagcccccaaactcattatttatgaggtcaataatcggccctcaggagtttctaatcgcttctctggctccaagtctggcaacacggcctccctgagcatctctgggctccaggctgaggacgaggctgattattactgcagctcatatactattagcagaactgtggttttcggcggagggaccaaggtgaccgtcctaggtcagcccaaggctgccccctcggtcactctcg

SEQ ID NO: 560955 - DNA, 493 bp, Homo sapiens; identical to SEQ ID NO: 536969
  misc_feature: HIJSMM301CZHMQ.27.78.H01.1.454.light.4.raw

SEQ ID NO: 560956 - DNA, 500 bp, Homo sapiens
  misc_feature: HIJSMM301BE9TX.22.38.D05.1.454.light.4.raw
acatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccgggggaaagagccaccctctcctgcagggccagtcagaatgttagtagttacttagcctggtaccagcaaaagcctggccaggctcccagactcctacatctctgatacatccaacagggccactggcatcccagccaggttcagtggcagtgggtctgggacagacttcactctcaccatcagcgacctagagcctgaagattttgcagtttattactgtcagcagcgtagcatctggcctccgtacacctttggccaggggaccaagctggagatcaaacgaactgtggctgcaccatctgtcttcat

SEQ ID NO: 560957 - DNA, 486 bp, Homo sapiens; identical to SEQ ID NO: 544919
  misc_feature: HIJSMM301D4MEK.7.85.H08.1.454.light.4.raw

SEQ ID NO: 560958 - DNA, 486 bp, Homo sapiens; identical to SEQ ID NO: 547872
  misc_feature: HIJSMM301AGGHR.14.55.E11.1.454.light.4.raw

SEQ ID NO: 560959 - DNA, 506 bp, Homo sapiens; identical to SEQ ID NO: 534969
  misc_feature: HIJSMM301CMV50.18.37.D04.1.454.light.4.raw

SEQ ID NO: 560960 - DNA, 494 bp, Homo sapiens; identical to SEQ ID NO: 534994
  misc_feature: HIJSMM301DCPG7.27.78.H01.1.454.light.4.raw

SEQ ID NO: 560961 - DNA, 481 bp, Homo sapiens
  misc_feature: HIJSMM301EP5SI.13.5.A05.1.454.light.4.raw
tcacgtactacacgaccggtgctcgatttagatagatagacaggggacacaagctcagctgtaactgtgccttgactgatcaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcgggcctccggggtccctaacaggttcagtggcagtggatcaggcacagattttacactgaaaatcagcagagtggaggctgaggatgttggggtttattactgcatgcaagctctacaacctctgcggactttcggccc

SEQ ID NO: 560962 - DNA, 477 bp, Homo sapiens; identical to SEQ ID NO: 535266
  misc_feature: HIJSMM301D6ZPE.4.34.D01.1.454.light.4.raw

SEQ ID NO: 560963 - DNA, 487 bp, Homo sapiens
  misc_feature: HIJSMM301EDQIE.12.33.C11.1.454.light.4.raw
atacgacgtacacgaccggtgctcgatttagagtgagctcgttgggtttgggggcaggagtcagtctcagtcaggacacagcatggacatgagggtccccgctcagctcctggggctcctgctactctggctccgaggtgccagatgtgacatccagatgacccagtctccttcctccctgtctgcatctgtcggagacagcgtcaccatcacttgtcgggcaagtcagaacatttacaattatttaaattggtatcagcagaaaccagggaaagcccctaaactcctgatctatcatgaatccagtttgcgaagtggagtcccatcaaggttcagtggcactgggtctgagacagagtttcactctcaccatcagcactctacagcctgaagattttgcaacttattattgtcaacaaagttatgagacccctgccactttcggccctgggaccatagtggatatgaaacgaactgtggctgcacc

SEQ ID NO: 560964 - DNA, 486 bp, Homo sapiens; identical to SEQ ID NO: 535043
  misc_feature: HIJSMM301DHBV7.46.35.D02.1.454.light.4.raw

SEQ ID NO: 560965 - DNA, 523 bp, Homo sapiens
  misc_feature: HIJSMM301AJCQJ.27.23.C01.1.454.light.4.raw
agcgtcgtctcacgaccggtgctcgatttagtacacgtgattagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccgaggctgaccgtcctaggtcagcccaaggctgccccctcggtcactctgttcccaccct

SEQ ID NO: 560966 - DNA, 466 bp, Homo sapiens; identical to SEQ ID NO: 536398
  misc_feature: HIJSMM301B2YWD.3.20.B09.1.454.light.4.raw

SEQ ID NO: 560967 - DNA, 484 bp, Homo sapiens; identical to SEQ ID NO: 536162
  misc_feature: HIJSMM301DFP13.13.59.F04.1.454.light.4.raw

SEQ ID NO: 560968 - DNA, 513 bp, Homo sapiens; identical to SEQ ID NO: 539258
  misc_feature: HIJSMM301CPQ42.43.19.B08.1.454.light.4.raw

SEQ ID NO: 560969 - DNA, 496 bp, Homo sapiens
  misc_feature: HIJSMM301CG6K8.3.37.D04.1.454.light.4.raw
agacgcactccacgaccggtgctcgatttagtagcatactgttgggtttggggtgatcaggactcctcagttcaccttctcacaatgaggctccctgctcagctcctggggctgctaatgctctgggtctctggatccagtggggacattgtcatgactcagtctccactctccctggccgtcacacctggagagacggcctccatctcctgcaggtctagtgagagcgtccagggtaatggatacgactatttggattggtacctgcagaagccagggcagcccccacaactcctgatctacttggcttctaatcgggcctccggggtccctgacaggttcagcggcagtggatcaggcacagattttaaactgataatcagccgcgtggaggctgaggatgttgggatttattactgcgtgcaagttcgacaaaccccattcactttcggccctgggaccaaagtggacatcaaacgaactgtggctgcaccat

SEQ ID NO: 560970 - DNA, 493 bp, Homo sapiens
  misc_feature: HIJSMM301DUOK9.43.60.F05.1.454.light.4.raw
tgtgagtagtcacgaccggtgctcgatttagtacgtcatcagggaaagggggcaggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcggtccacgggaccgacggtcggatgtctaagacgaactcgtggcgtgcgacca

SEQ ID NO: 560971 - DNA, 499 bp, Homo sapiens
  misc_feature: HIJSMM301ARXWV.48.83.H06.1.454.light.4.raw
agtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcagggggacccaggccttggatgaggctgactatcactgtcaggcgtgggacagcaacactgcgattttcggcgggggaccgaggctgaccgtcggcggtcagcccaaggctgccccctcggtcactctgttccc

SEQ ID NO: 560972 - DNA, 484 bp, Homo sapiens
  misc_feature: HIJSMM301CMPOH.4.57.F02.1.454.light.4.raw
  modified_base (482)..(482): a, c, t, g, unknown or other
agcactgtagcacgaccggtgctcgatttagctcgatatagttgggtttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtggggtcccatcaagattcagtggcagtggatctgggacagatttcactctcaccatcagtagtctacaacctgaagattttgcaacttactactgtcaacagagttacgatacccctccgctcactttcggcggagggaccaaggtggagatcaacgaactgtggctgcncc

SEQ ID NO: 560973 - DNA, 517 bp, Homo sapiens; identical to SEQ ID NO: 543501
  misc_feature: HIJSMM301AFNKG.47.53.E09.1.454.light.4.raw

SEQ ID NO: 560974 - DNA, 502 bp, Homo sapiens
  misc_feature: HIJSMM301BO8ZA.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacacccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcggagggaccaagctgaccgtcctgggtcagcccaaggctgccccctcggtca

SEQ ID NO: 560975 - DNA, 444 bp, Homo sapiens; identical to SEQ ID NO: 535192
  misc_feature: HIJSMM301DO8P4.5.9.A09.1.454.light.4.raw

SEQ ID NO: 560976 - DNA, 483 bp, Homo sapiens; identical to SEQ ID NO: 550161
  misc_feature: HIJSMM301BLQUW.4.1.A01.1.454.light.4.raw

SEQ ID NO: 560977 - DNA, 489 bp, Homo sapiens; identical to SEQ ID NO: 537328
  misc_feature: HIJSMM301B0GEA.13.5.A05.1.454.light.4.raw

SEQ ID NO: 560978 - DNA, 430 bp, Homo sapiens
  misc_feature: HIJSMM301CUACD.18.78.H01.1.454.light.4.raw
tacgagtatgcacgaccggtgctcgatttagtgtgagtagtttgggtttgggggctttgcctgggtgctgttggtaccaggagacatagttataaccaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccactgtcactctgttcccaccctcctccatactcgta

SEQ ID NO: 560979 - DNA, 476 bp, Homo sapiens; identical to SEQ ID NO: 547708
  misc_feature: HIJSMM301DGOCG.12.1.A01.1.454.light.4.raw

SEQ ID NO: 560980 - DNA, 516 bp, Homo sapiens
  misc_feature: HIJSMM301B9CXL.41.25.C03.1.454.light.4.raw
tctatactatcacgaccggtgctcgatttagtagtgtagatttgggtttggggatagctcaggaagcagagcctggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctggggtccctttcggttttctggctccatcgacagtccctccaactccgcctcccttaccatatctgggctgaagagtgaggacgaggctgactacttctgtcagtcttatgatataaacaattatgtgataattggcggagggaccagggtgaccgtcctaggtcagcccaaggctgccccctcggtcactctgttcccg

SEQ ID NO: 560981 - DNA, 487 bp, Homo sapiens; identical to SEQ ID NO: 555743
  misc_feature: HIJSMM301DDNU6.7.85.H08.1.454.light.4.raw

SEQ ID NO: 560982 - DNA, 494 bp, Homo sapiens; identical to SEQ ID NO: 535680
  misc_feature: HIJSMM301A5RQK.16.78.H01.1.454.light.4.raw

SEQ ID NO: 560983 - DNA, 383 bp, Homo sapiens; identical to SEQ ID NO: 447524
  misc_feature: HIJSMM301CR5CV.41.26.C04.1.454.light.4.raw

SEQ ID NO: 560984 - DNA, 505 bp, Homo sapiens
  misc_feature: HIJSMM301BTMYX.41.18.B07.1.454.light.4.raw
tctatactatcacgaccggtgctcgatttagtcgctgcgtaagggggtgggtccaggaggcagaactctgggtgtctcaccatggccctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcaggggatccctgagcgattctctggcgccagctcaggaacagtagtcacgttgaccatcagtggagtccaggcagaagacgaggctgactattattgtcaagcagtagacagcagtggtccttatcgggtgttcggcgggggaccaaggctgaccgtcctaggtcagcccaaggcctgccccctcggtcactctgttccccg

SEQ ID NO: 560985 - DNA, 349 bp, Homo sapiens
  misc_feature: HIJSMM301A04C5.19.86.H09.1.454.light.4.raw
tactctcgtgcacgaccggtgctcgatttagtgctatagacttgggtttgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccaccctcctccacgagagta

SEQ ID NO: 560986 - DNA, 503 bp, Homo sapiens
  misc_feature: HIJSMM301E0TH5.9.12.B01.1.454.light.4.raw
tgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttatactgtcaacagttttctcgggcgttcggccgaacggaccgaacggtggaaagtcaaacgaactagtggctgcaccta

SEQ ID NO: 560987 - DNA, 481 bp, Homo sapiens
  misc_feature: HIJSMM301CIZU7.12.1.A01.1.454.light.4.raw
atacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaagtttcagtggcagtgggtctggggacagatttcactcttcaccatcagcagtctgcaacctgaagattctgcaacttattactgtcaacagagtaacagttaccctcccactttcggcggagggaccaaggtggaggatcaaacgaactgtggctgcaa

SEQ ID NO: 560988 - DNA, 521 bp, Homo sapiens
  misc_feature: HIJSMM301DJBEK.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtacgttcatatacaaccagtgacacttgggtgttcggcggagggaccaggctgaccgtcctaggtcagcccaaggctgccccctcggtcactctgttccgccct

SEQ ID NO: 560989 - DNA, 441 bp, Homo sapiens; identical to SEQ ID NO: 535074
  misc_feature: HIJSMM301E0IS6.11.3.A03.1.454.light.4.raw

SEQ ID NO: 560990 - DNA, 505 bp, Homo sapiens; identical to SEQ ID NO: 539292
  misc_feature: HIJSMM301DIGSZ.19.85.H08.1.454.light.4.raw

SEQ ID NO: 560991 - DNA, 477 bp, Homo sapiens; identical to SEQ ID NO: 540405
  misc_feature: HIJSMM301ERZBK.3.82.H05.1.454.light.4.raw

SEQ ID NO: 560992 - DNA, 503 bp, Homo sapiens; identical to SEQ ID NO: 536834
  misc_feature: HIJSMM301AQEYO.2.35.D02.1.454.light.4.raw

SEQ ID NO: 560993 - DNA, 486 bp, Homo sapiens; identical to SEQ ID NO: 535043
  misc_feature: HIJSMM301CEGQC.46.35.D02.1.454.light.4.raw

SEQ ID NO: 560994 - DNA, 503 bp, Homo sapiens
  misc_feature: HIJSMM301B40OG.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcgggcggagggaccaaactcggaccgtcctaggtcagccc

SEQ ID NO: 560995 - DNA, 505 bp, Homo sapiens
  misc_feature: HIJSMM301BCJWV.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcatggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaaccccactgtcactctgtt

SEQ ID NO: 560996 - DNA, 383 bp, Homo sapiens; identical to SEQ ID NO: 550682
  misc_feature: HIJSMM301APYNJ.48.87.H10.1.454.light.4.raw

SEQ ID NO: 560997 - DNA, 511 bp, Homo sapiens; identical to SEQ ID NO: 537464
  misc_feature: HIJSMM301CA6NS.7.34.D01.1.454.light.4.raw

SEQ ID NO: 560998 - DNA, 484 bp, Homo sapiens; identical to SEQ ID NO: 535400
  misc_feature: HIJSMM301B3NQ7.46.26.C04.1.454.light.4.raw

SEQ ID NO: 560999 - DNA, 480 bp, Homo sapiens
  misc_feature: HIJSMM301B9MBW.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggttttggctgttcgcggcgggacc

SEQ ID NO: 561000 - DNA, 483 bp, Homo sapiens; identical to SEQ ID NO: 536836
  misc_feature: HIJSMM301AFB1N.3.38.D05.1.454.light.4.raw

SEQ ID NO: 561001 - DNA, 508 bp, Homo sapiens; identical to SEQ ID NO: 552440
  misc_feature: HIJSMM301AVD84.5.24.C02.1.454.light.4.raw

SEQ ID NO: 561002 - DNA, 509 bp, Homo sapiens; identical to SEQ ID NO: 539359
  misc_feature: HIJSMM301BQKCO.47.85.H08.1.454.light.4.raw

SEQ ID NO: 561003 - DNA, 488 bp, Homo sapiens; identical to SEQ ID NO: 535081
  misc_feature: HIJSMM301D5378.26.23.C01.1.454.light.4.raw

SEQ ID NO: 561004 - DNA, 501 bp, Homo sapiens; identical to SEQ ID NO: 555551
  misc_feature: HIJSMM301BM3TV.21.81.H04.1.454.light.4.raw

SEQ ID NO: 561005 - DNA, 493 bp, Homo sapiens
  misc_feature: HIJSMM301B4L7L.19.71.G05.1.454.light.4.raw
tactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaactgtggctgca

SEQ ID NO: 561006 - DNA, 496 bp, Homo sapiens; identical to SEQ ID NO: 535612
  misc_feature: HIJSMM301EJEMM.22.9.A09.1.454.light.4.raw

SEQ ID NO: 561007 - DNA, 500 bp, Homo sapiens
  misc_feature: HIJSMM301AZ416.51.80.H03.1.454.light.4.raw
cgatcgtatacacgaccggtgctcgatttagctgtgcgtcgaagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaactcatgatttatgaggtcagtaagcggccctcaggggtccctgatcgcttctctggctccaagtctggcaacacggcctccctgaccgtctctgggctccaggctgaggatgaggctgattattactgctgctcacatgcaggcagcatcggtgtgctattcggcggagggaccaagctgaccgtcctaggtcagcccaaggctgccccccg

SEQ ID NO: 561008 - DNA, 488 bp, Homo sapiens
  misc_feature: HIJSMM301DYRXU.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatacgaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggcaaggaccgaaggtggatatcagacgaa

SEQ ID NO: 561009 - DNA, 495 bp, Homo sapiens; identical to SEQ ID NO: 535821
  misc_feature: HIJSMM301APXAX.3.31.C09.1.454.light.4.raw

SEQ ID NO: 561010 - DNA, 444 bp, Homo sapiens; identical to SEQ ID NO: 535594
  misc_feature: HIJSMM301CHSD3.9.9.A09.1.454.light.4.raw

SEQ ID NO: 561011 - DNA, 472 bp, Homo sapiens
  misc_feature: HIJSMM301CS7JI.12.1.A01.1.454.light.4.raw
atacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaagtttcagtggcagtgggtctgggacagatttcactctcaccatcagcagtctgcaacctgaagattctgcaacttattactgtcaacagagtaacagttaccctcccactttcggcggagggaccaaggtggagatcaaacgaactgtgg

SEQ ID NO: 561012 - DNA, 495 bp, Homo sapiens; identical to SEQ ID NO: 554164
  misc_feature: HIJSMM301BAXXZ.27.78.H01.1.454.light.4.raw

SEQ ID NO: 561013 - DNA, 488 bp, Homo sapiens
  misc_feature: HIJSMM301CXDXM.49.72.G06.1.454.light.4.raw
agtcgagagacacgaccggtgctcgatttagctacgactgcaagggaaagggggaagagctgctcagttaggacccagagggaaccatggaaaccccagcgcagcttctcttcctcctgctactctggctcccagataccaccgcagaaattgtgttgacgcagtctccaggcaccctgtctttgtctccaggggaaagagccaccctctcctgcagggccagtcagagcgttagcaacagttatgtagcctggtaccagcagaaacctggccagtctcccaggctcctcatctatgctgcgtccagcagggccactggcatcccggacaggttcagtggcagtgggtctgggacagacttctctctcaccatcagcagactggagcctgaagattttgcagtatattactgtcagcatgggagcattcgtgcgctcaccttcggcggagggaccaaggtggagatcaaacgaactgtggctgcacca

SEQ ID NO: 561014 - DNA, 500 bp, Homo sapiens
  misc_feature: HIJSMM301EAP27.3.33.C11.1.454.light.4.raw
agacgcactccacgaccggtgctcgatttagagtgagctcgttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagcctgaccgtcctaggtcagcccaaggctcgccccccg

SEQ ID NO: 561015 - DNA, 492 bp, Homo sapiens
  misc_feature: HIJSMM301D4ELS.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgagtgtattactgtcagcagtatcataggtcaaacaccttcggccaagggacacgactggagattaaaggaactgtggctgcaccatctgtcttcatcttcccg

SEQ ID NO: 561016 - DNA, 447 bp, Homo sapiens; identical to SEQ ID NO: 541817
  misc_feature: HIJSMM301AM1O8.18.9.A09.1.454.light.4.raw

SEQ ID NO: 561017 - DNA, 479 bp, Homo sapiens; identical to SEQ ID NO: 538734
  misc_feature: HIJSMM301EH47B.8.53.E09.1.454.light.4.raw

SEQ ID NO: 561018 - DNA, 482 bp, Homo sapiens
  misc_feature: HIJSMM301BFK2D.46.26.C04.1.454.light.4.raw
actagcagtacacgaccggtgctcgatttagtctagcgactttgggtttgggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcgagggaccaaggtggagatcaaacgaa

SEQ ID NO: 561019 - DNA, 514 bp, Homo sapiens
  misc_feature: HIJSMM301DPNIR.40.27.C05.1.454.light.4.raw
tctagcgactcacgaccggtgctcgatttagacgcgatcgaagggtttggggagcttcagctgtggtggagaagacaggattcaggccaatctccagcatggccggcttccctctcctcctcaccctcctcactcactgtgcagggtcctgggcccagtctgtgctgactcagccaccctcagcgtctgagacccccgggcagcaggttaccgtctcttgttctggaagcagctccaacatcggaagtaattctgtatactggtaccagtgcctcccaggaacggcccccaaacttctcgtctatagggattatcagcggcccttaggggtccctgaccgattctctggctccaggtctggcacctcagcctccctggccatcagtgggctccggcccgaggatgaggcggattattattgtgtgtcatgggatgacagaatgaatggtccggtgttcggcggagggaccaggctgaccgtcctaggtcagcccaaggctgcccctcggtcact

SEQ ID NO: 561020 - DNA, 504 bp, Homo sapiens; identical to SEQ ID NO: 535077
  misc_feature: HIJSMM301D0N2F.8.28.C06.1.454.light.4.raw

SEQ ID NO: 561021 - DNA, 488 bp, Homo sapiens; identical to SEQ ID NO: 537260
  misc_feature: HIJSMM301DKHPK.47.70.G04.1.454.light.4.raw

SEQ ID NO: 561022 - DNA, 493 bp, Homo sapiens
  misc_feature: HIJSMM301D5EC8.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgactgtggctgcaccatctgtctt

SEQ ID NO: 561023 - DNA, 506 bp, Homo sapiens
  misc_feature: HIJSMM301D5Z4B.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaggaccaaggtggaagtcaagcgaactgtggctgcaccatctgtcttcatcttcccgcc

SEQ ID NO: 561024 - DNA, 478 bp, Homo sapiens; identical to SEQ ID NO: 535129
  misc_feature: HIJSMM301DALWG.11.11.A11.1.454.light.4.raw

SEQ ID NO: 561025 - DNA, 443 bp, Homo sapiens
  misc_feature: HIJSMM301CL2S1.7.18.B07.1.454.light.4.raw
  modified_base (356)..(356): a, c, t, g, unknown or other
cgtgtctctacacgaccggtgctcgatttagtcgctgcgtaagggtcctgggcccagtctgtactgacgcagccgccctcagtatctggggccccagggcagagggtctccatctcctgcactgggagcagctcccacagcggggcaggttctgatgttcactggtaccagcagcttccagggacagcccccaaactcctcatatacgagaacaccaatcggccctcaggagtccctgaccgattctctggctccaagtctggcacctcagcctccctggccatcactgggctccaggctgaggatgaggctgattattactgccagtcgtatgacagcagcctgagtgtttgggngttcggcggagggaccaagctgaccgtcctcgtcagcccaaggctgccccctcggtcactctgttcccaccctcctctagagacacg

SEQ ID NO: 561026 - DNA, 489 bp, Homo sapiens
  misc_feature: HIJSMM301A5IPW.19.71.G05.1.454.light.4.raw
tactctcgtgcacgaccggtgctcgatttagtgtcgtcgcaagagagaggggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatcgaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaa

SEQ ID NO: 561027 - DNA, 508 bp, Homo sapiens
  misc_feature: HIJSMM301A6C3V.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttggtgttcggcggagggaccaagttgaccgtcctaggtcagcccaaggctgccccctcggtcactctgtt

SEQ ID NO: 561028 - DNA, 515 bp, Homo sapiens; identical to SEQ ID NO: 541016
  misc_feature: HIJSMM301A2IN0.43.23.C01.1.454.light.4.raw

SEQ ID NO: 561029 - DNA, 483 bp, Homo sapiens; identical to SEQ ID NO: 535413
  misc_feature: HIJSMM301DXYDA.26.78.H01.1.454.light.4.raw

SEQ ID NO: 561030 - DNA, 495 bp, Homo sapiens; identical to SEQ ID NO: 537716
  misc_feature: HIJSMM301EKA2J.22.14.B03.1.454.light.4.raw

SEQ ID NO: 561031 - DNA, 500 bp, Homo sapiens; identical to SEQ ID NO: 546613
  misc_feature: HIJSMM301CM8CL.11.21.B10.1.454.light.4.raw

SEQ ID NO: 561032 - DNA, 502 bp, Homo sapiens
  misc_feature: HIJSMM301ATYWE.48.35.D02.1.454.light.4.raw
agtatacatacacgaccggtgctcgatttagcacacgatagttgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaatatgcttattggtaccagcagaagtcaggccaggcccctgtgctggtcatctttgaggacaacaaacgaccctccgggatccctgagagattctctggctccagctcagggacaatggccaccttgactatcaatggggcccaggtggacgatgaggctgactactactgttcctcaacagacagtagtggtgatcgagggctgttcggcggagggaccaagctgaccgtcctaagtcagcccaaggctgccccctcggtcactctcg

SEQ ID NO: 561033 - DNA, 491 bp, Homo sapiens; identical to SEQ ID NO: 535294
  misc_feature: HIJSMM301A64XR.16.68.G02.1.454.light.4.raw

SEQ ID NO: 561034 - DNA, 506 bp, Homo sapiens
  misc_feature: HIJSMM301CSDXT.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccacctttcggcccgtcggaccaagtggatatcaaacgaactagtggctgcaccatctgtt

SEQ ID NO: 561035 - DNA, 486 bp, Homo sapiens; identical to SEQ ID NO: 536329
  misc_feature: HIJSMM301BQFE2.21.4.A04.1.454.light.4.raw

SEQ ID NO: 561036 - DNA, 445 bp, Homo sapiens
  misc_feature: HIJSMM301AN0DP.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagccaaggccaaccctctgtcactctgttcccaccctcctccatactcgta

SEQ ID NO: 561037 - DNA, 476 bp, Homo sapiens; identical to SEQ ID NO: 537368
  misc_feature: HIJSMM301C7BQC.7.83.H06.1.454.light.4.raw

SEQ ID NO: 561038 - DNA, 491 bp, Homo sapiens; identical to SEQ ID NO: 535294
  misc_feature: HIJSMM301CFQB4.16.68.G02.1.454.light.4.raw

SEQ ID NO: 561039 - DNA, 489 bp, Homo sapiens
  misc_feature: HIJSMM301BTN4F.10.59.F04.1.454.light.4.raw
catagtagtgcacgaccggtgctcgatttagtacacacacttagggattggggggggtctcaggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcaccatctcctgcactggaaccagcagtgatgttggtggttatgactttgtctcctggtaccaacagcagccaggcgaagcccccaaattcatgatttatgatgtcagtgcgcggccctcgggggtccctgatcgcttctctggctccaagtctggcaacacggcctccctgaccatctctggcctccagcctgaggatgaggctgattattactgttgctcatatgcaggcggtaccgcttgggtgttcggcggagggaccaagctgaccgtcctaggtcagccccg

SEQ ID NO: 561040 - DNA, 464 bp, Homo sapiens
  misc_feature: HIJSMM301BCP8I.53.38.D05.1.454.light.4.raw
cgcgtatacacacgaccggtgctcgatttagtatctgatagttgggtttggggctcctcactctctgcacaggctctgaggcctcctatgaggtgacacagccaccctcggtgtcagtgtccccaggacagacggccaggatcacctgctctggagaggcattggcaaaacaatatggatattggtaccggcagaagccaggccaggcccctgtgttggtaatatataaagacagggagaggcccccagggatccctgagcgatactctggctccagctcagggacaacagtcacattgaccatcagtggagtccaggcagaagacgaggctgactattactgtcaatctgcggacagcagtggttctcatgtggtattcggcggagggaccaagctgaccgtcctaggtcagcccaaggctgccccctcggtcactctgttcccgccctcctctcgtactgcg

SEQ ID NO: 561041 - DNA, 489 bp, Homo sapiens; identical to SEQ ID NO: 535139
  misc_feature: HIJSMM301AKNKI.14.55.E11.1.454.light.4.raw

SEQ ID NO: 561042 - DNA, 491 bp, Homo sapiens
  misc_feature: HIJSMM301AXNLD.43.33.C11.1.454.light.4.raw
tgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctcccccctacaatttcggtcagggaccaagttgaacatcaatcgaactgtggctgcaccatctgtctt

SEQ ID NO: 561043 - DNA, 507 bp, Homo sapiens
  misc_feature: HIJSMM301CAROQ.47.83.H06.1.454.light.4.raw
agctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatactcccccagctggtaccagcagaccccgggccagactccacgcacgcccatctacaacacagacactcgctcttctggggtccctgatcgcttctctggttccatccttgggaacaaagctgccctcaccatcgcgggggcccaggcagatgatgagtgtgattattactgtgtgctctatatgggcagtggcgtttgggtgttcggcggaggaccaagctgaccgtctta

SEQ ID NO: 561044 - DNA, 512 bp, Homo sapiens
  misc_feature: HIJSMM301AKP43.17.28.C06.1.454.light.4.raw
cgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtcccgtcgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggctgccccccg

SEQ ID NO: 561045 - DNA, 507 bp, Homo sapiens
  misc_feature: HIJSMM301EXPSG.17.41.D08.1.454.light.4.raw
cgtagactagcacgaccggtgctcgatttagtcacgcgagaaagggaaagggggaagagctgctcagttaggacccagagggaaccatggaaaccccagcgcagcttctcttcctcctgctactctggctcccagataccaccggagaaattgtgttgacgcagtctccaggcaccctgtccttgtctccaggggaaacagccaccctctcctgtagggccagtcagagtgtttttaaaaactatttagcctggtaccaacagaagcctggccaggctcccaggctcctcatctatggtgcatccaccagggccactggcatcccagacaggttcagtggcggtgggtctgggacagaattcactctcaccatcaccagtctggagcctgaagattttgctctgtatcactgtcagcaatatggtggtacacccctcactttcggcggaggggccaaggtggagatcaagcgaactgtggctgcaccatctgtcttcatcttccgcc

SEQ ID NO: 561046 - DNA, 478 bp, Homo sapiens; identical to SEQ ID NO: 535129
  misc_feature: HIJSMM301EY1OB.11.11.A11.1.454.light.4.raw

SEQ ID NO: 561047 - DNA, 496 bp, Homo sapiens; identical to SEQ ID NO: 535541
  misc_feature: HIJSMM301A164J.3.33.C11.1.454.light.4.raw

SEQ ID NO: 561048 - DNA, 501 bp, Homo sapiens; identical to SEQ ID NO: 548357
  misc_feature: HIJSMM301D4KJ4.19.67.G01.1.454.light.4.raw

SEQ ID NO: 561049 - DNA, 479 bp, Homo sapiens; identical to SEQ ID NO: 535531
  misc_feature: HIJSMM301EBSYV.41.17.B06.1.454.light.4.raw

SEQ ID NO: 561050 - DNA, 507 bp, Homo sapiens; identical to SEQ ID NO: 550627
  misc_feature: HIJSMM301CA3CF.49.23.C01.1.454.light.4.raw

SEQ ID NO: 561051 - DNA, 457 bp, Homo sapiens
  misc_feature: HIJSMM301CNX6C.18.78.H01.1.454.light.4.raw
tacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaaccccactgtcactctgttcccaccctcctccatactcgta

SEQ ID NO: 561052 - DNA, 501 bp, Homo sapiens
  misc_feature: HIJSMM301B2MV4.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactatactgtgcatcacgggacgcaacatgggatgacaatctgagcggttgggtgttcggcggagggaccaaactgaccgtcctaggtcagcccaa

SEQ ID NO: 561053 - DNA, 504 bp, Homo sapiens
  misc_feature: HIJSMM301CBSXS.10.71.G05.1.454.light.4.raw
catagtagtgcacgaccggtgctcgatttagtgtcgtcgcaagagagagggggagagccctggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccacttttcggcggagggaccaaaatagaggtcaaacgaactagtggctgcacca

SEQ ID NO: 561054 - DNA, 487 bp, Homo sapiens
  misc_feature: HIJSMM301B3O8H.15.49.E05.1.454.light.4.raw
tctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccactggcatcccagccacgttcagtggcagtgggtctgggacagagttcattctcaccatcagcagcctgcagtctgaagattttgcagtttatactgtcagcagtataatgactggcctccgacgttcggccaagggaccaaggtggaaatcaaacgaactgtggctgcaccat

SEQ ID NO: 561055 - DNA, 473 bp, Homo sapiens
  misc_feature: HIJSMM301A81VK.4.54.E10.1.454.light.4.raw
agcactgtagcacgaccggtgctcgatttagatcgtagcagaacacacaaaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcagcatcacttgccgggcaagtcagagcattagctacttttttaagttggtatcagcagacaccagggaaagcccctaagctcctgatctatgctgcttccagtttgcaaagtgggtcccatcaaggttcagtggcagtggatctgggacagatttcactctcactgtcagcagtctgcaatttgaagattttgcaacttactactgtcaacagagtttcagtatcccttggactttcggccaagggaccaaggtaggaaatcaaacgaa

SEQ ID NO: 561056 - DNA, 469 bp, Homo sapiens
  misc_feature: HIJSMM301CQOFW.5.28.C06.1.454.light.4.raw
atcagacacgcacgaccggtgctcgatttagagctcacgtattgggtttgggggcaggagtcagtcccaaccaggacacagcatggacatgagggtccctgctcagctcctggggctcctgctgctctggctctcaggtgccagatgtgacatccagatgacccagtctccatcgtccgtgtctgcatctgtaggagacagagtcaccatcacttgtcaggcgagtcaggacattggtaattacttaacttggtatcagcagaaaccagggaaagtccccaaactcctgatctacgatgcatctaatttggaaataggggtctcatcaaggttcagtgggagtggatctgggacagaattcactttcaccatcagcagcctgcaacctgaagatattgcaacatattactgtcaacagtatgatagtctggccgcttcggcggagggaccaaggtggagatcgaacgaa

SEQ ID NO: 561057 - DNA, 486 bp, Homo sapiens
  misc_feature: HIJSMM301DA9OP.4.33.C11.1.454.light.4.raw
agcactgtagcacgaccggtgctcgatttagagtgagctcgttgggttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcggcggagggaccgaaggtggagatcaaacgaa

SEQ ID NO: 561058 - DNA, 505 bp, Homo sapiens
  misc_feature: HIJSMM301D0Q92.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgtcatgcaaactacacacggccgctcactttcggcggagggaccaaggtggagatcaaacgaactagtggctgcaccatct

SEQ ID NO: 561059 - DNA, 508 bp, Homo sapiens
  misc_feature: HIJSMM301BM1QO.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcgggcgttcggccaagggaccgaaggtggaaagtacaaacgaactagtggctgcaccatctgtcttctatcttccccg

SEQ ID NO: 561060 - DNA, 486 bp, Homo sapiens
  misc_feature: HIJSMM301CT3VA.51.61.F06.1.454.light.4.raw
cgatcgtatacacgaccggtgctcgatttagctacgctctaagggaaaggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagcatttctttagcctggtatcagcaaaaaccagggaaagcccctaagctcctgatctatgctgcatccactttgcaaactggagtcccatcaaggttcagcggcagtggatctgggacagaattcactctcacaatcagcagcctgcagcctgaagattttgcaacttattactgtcaacagcttaatacttatcctcggacgttcggccaaggaccgaacggtaggaaatacaaacgaactagtggctgcaccatctgt

SEQ ID NO: 561061 - DNA, 488 bp, Homo sapiens
  misc_feature: HIJSMM301A9EDN.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagtccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattatgtcaatcagcagacaacagtaatacttatctttatgtcttcggatctgggaccagggtcaccgtcctaggtcagcccaaggccaaccccca

SEQ ID NO: 561062 - DNA, 486 bp, Homo sapiens
  misc_feature: HIJSMM301BRY3C.52.30.C08.1.454.light.4.raw
cgcagtacgacacgaccggtgctcgatttagtctgacgtcaaagggaaagggggagtcagtcccaaccaggacacagcatggacatgagggtccctgctcagctcctggggctcctgctgctctggctctcaggtgccagatgtgtcatccagatgacccagtctccatcctccctgtctgcatctgtaggagacagagtcaccatcacttgccaggcgagtcaggacattagcaactatttaaattggtatcagctgaaacccgggaaagcccctaagctcctgatcctcgatgcattcactttggaaacaggggtcccatcaaggttcagtgggagtggctctgggacagatttttactttcaccatcagcagcctgcagcctgaggatattgcaacatattactgtcaacagtacgataatctcccgctcactttcggcggggggaccaaggtggaggatcaaacgaactgtggctgcaccat

SEQ ID NO: 561063 - DNA, 491 bp, Homo sapiens
  misc_feature: HIJSMM301E34YH.40.37.D04.1.454.light.4.raw
tctagcgactcacgaccggtgctcgatttagtagcatactgttgggtttgggggatcaggacttctcagttcatcttctcaccatgaggctccctgctcagctcctggggctgctaatgctctggatccctggttccagtgcgagggttgtgatgactcagactccactctctctgtccgtcacccctggacagccggcctccatctcctgcaagtctgctcagagcctcctgcatggtgatggaatcacctatttatattggtacctgcagaagccaggccagtctccacagctcctaatctatgaggtttccagccggttctctggagtgccagataggttcagtggcagcgggtcagtgacagatttcacactgaaaatcagccgggtggaggctgaggatgttggggtttattactgcatgcaaggtttataccttcctcggacttcgtcccgtcggacgacgagtggagtgtctaacgaaactagt

SEQ ID NO: 561064 - DNA, 494 bp, Homo sapiens; identical to SEQ ID NO: 536974
  misc_feature: HIJSMM301AEB9D.16.86.H09.1.454.light.4.raw

SEQ ID NO: 561065 - DNA, 490 bp, Homo sapiens
  misc_feature: HIJSMM301A5WHA.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcgtccacgggaccgacggtcggagtgtcaagacgaactagtggcgtgcgaccact

SEQ ID NO: 561066 - DNA, 447 bp, Homo sapiens; identical to SEQ ID NO: 535201
  misc_feature: HIJSMM301BR0N4.18.9.A09.1.454.light.4.raw

SEQ ID NO: 561067 - DNA, 486 bp, Homo sapiens; identical to SEQ ID NO: 535043
  misc_feature: HIJSMM301DINVZ.46.35.D02.1.454.light.4.raw

SEQ ID NO: 561068 - DNA, 484 bp, Homo sapiens; identical to SEQ ID NO: 535240
  misc_feature: HIJSMM301EN7ES.47.60.F05.1.454.light.4.raw

SEQ ID NO: 561069 - DNA, 504 bp, Homo sapiens
  misc_feature: HIJSMM301AXJG8.19.78.H01.1.454.light.4.raw
tactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccactgtca

SEQ ID NO: 561070 - DNA, 460 bp, Homo sapiens
  misc_feature: HIJSMM301B32PQ.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttgggtgttcggcgtagggaccaggctgaccgtcctaggtcagcccaaggctgccccctcggtcactctgttcccaccctcctcacgcgtatgt

SEQ ID NO: 561071 - DNA, 501 bp, Homo sapiens; identical to SEQ ID NO: 535746
  misc_feature: HIJSMM301EAMMU.18.11.A11.1.454.light.4.raw

SEQ ID NO: 561072 - DNA, 484 bp, Homo sapiens
  misc_feature: HIJSMM301CWGZP.52.22.B11.1.454.light.4.raw
cgcagtacgacacgaccggtgctcgatttagacgacagctcaggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcatttgccgggcaagtcagagtattagcagctatttaaattggtatcaacataccccggggaaggcccctaagttactgatctatgctgcagccaatttgcaaagtggggtcccatcaaggttcagtggcagtggatctgggacagaattcactctcaccatcagcagtctgcaacctgaagattttggaaagtactattgtcaacagagttacggaaacttgctcattttcggcggtagggaccaaggtggagatcaaacgaactgtggctgcaccatctgtcttcatt

SEQ ID NO: 561073 - DNA, 509 bp, Homo sapiens; identical to SEQ ID NO: 557518
  misc_feature: HIJSMM301CBZ1Z.8.34.D01.1.454.light.4.raw

SEQ ID NO: 561074 - DNA, 466 bp, Homo sapiens; identical to SEQ ID NO: 535366
  misc_feature: HIJSMM301EOBNM.13.4.A04.1.454.light.4.raw

SEQ ID NO: 561075 - DNA, 466 bp, Homo sapiens; identical to SEQ ID NO: 536398
  misc_feature: HIJSMM301CW59X.3.20.B09.1.454.light.4.raw

SEQ ID NO: 561076 - DNA, 486 bp, Homo sapiens
  misc_feature: HIJSMM301EP9CH.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctgttccccgccctcctcgctacgtaga

SEQ ID NO: 561077 - DNA, 494 bp, Homo sapiens
  misc_feature: HIJSMM301BM3UU.10.79.H02.1.454.light.4.raw
catagtagtgcacgaccggtgctcgatttagtgtcacacgaagggaaagggggagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggccaggggaccaagctggagatcaaacgactgtggctgcaccatctgtcttcta

SEQ ID NO: 561078 - DNA, 497 bp, Homo sapiens
  misc_feature: HIJSMM301BZR5J.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtacaaacaccttcggccaagggacacgactaggagattaaaggaactgtggctgcaccatctgtcttcatccttccccg

SEQ ID NO: 561079 - DNA, 507 bp, Homo sapiens
  misc_feature: HIJSMM301D3CQC.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaaactgaccgtcctgggtcagcccaaggctgccccctcggtcactt

SEQ ID NO: 561080 - DNA, 495 bp, Homo sapiens; identical to SEQ ID NO: 535821
  misc_feature: HIJSMM301EYCQC.3.31.C09.1.454.light.4.raw

SEQ ID NO: 561081 - DNA, 498 bp, Homo sapiens
  misc_feature: HIJSMM301BSES3.15.81.H04.1.454.light.4.raw
tctacgtagccacgaccggtgctcgatttagtagtgtagattcgcggggggggtcgtcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcggcggtgggaccaagctgaccgtcctaggtcagcccaaggctgccccctc

SEQ ID NO: 561082 - DNA, 487 bp, Homo sapiens; identical to SEQ ID NO: 541583
  misc_feature: HIJSMM301EYWHB.41.57.F02.1.454.light.4.raw

SEQ ID NO: 561083 - DNA, 504 bp, Homo sapiens; identical to SEQ ID NO: 549538
  misc_feature: HIJSMM301AGYWM.18.59.F04.1.454.light.4.raw

SEQ ID NO: 561084 - DNA, 523 bp, Homo sapiens
  misc_feature: HIJSMM301AHAUQ.47.78.H01.1.454.light.4.raw
agctcacgtacacgaccggtgctcgatttagtgtgagtagtttgggtttggggagagaagacaggattcaggacaatctccagcatggccggcttccctctcctcctcaccctcctcactcactgtgcagggtcctgggcccactctgtggtgactcagccaccctcagcgtctgggacccccgggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcagcctccctggccatcagtgggctccggtccgaggatgaggctgattattattgtgcaacatgggatagtagcctgagtagtgtggttttcggcggagggaccgaaactgaccgtcctaggtcagcccaaggctgccccctcggtcactctgttcccgccctcctctacg

SEQ ID NO: 561085 - DNA, 501 bp, Homo sapiens
  misc_feature: HIJSMM301APSR9.47.66.F11.1.454.light.4.raw
agctcacgtacacgaccggtgctcgatttagtcacgcgagaagggggaggaactgctcagttaggacccagagggaaccatggaagccccagctcagcttctcttcctcctgctactctggctcccagaaatcgccggagacattctattgacacaggctccagtcaccctgtctttgtctccaggggaaagagccaccctctcctgcagggccagtcaaagcatcggcaacaatttggcctggtatcaacagaaacctggccaggctcccaggctcctcatctacgatgcatccaacagggccactggcgtcccaggcaggttcagaggcggtgggtctgggacagacttcactctcaccattgacggcctagagcctgaagattttgctagtttattactgtcagcagcgtaacaattggccgatcaccttcggccaagggacacgactggagattaaacgaactgtggctgcaccatctgtcttcatcttcccgccat

SEQ ID NO: 561086 - DNA, 502 bp, Homo sapiens; identical to SEQ ID NO: 537363
  misc_feature: HIJSMM301BQ096.18.23.C01.1.454.light.4.raw

SEQ ID NO: 561087 - DNA, 483 bp, Homo sapiens
  misc_feature: HIJSMM301C6N5W.3.88.H11.1.454.light.4.raw
  modified_base (386)..(386): a, c, t, g, unknown or other
agacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccactttgcaaactgggtcccatccaggttcagcggcaggggatctgggacagatttcactctcaccatcagcagcctgcagcctnaagatttgtcaactaactatgtcacagacgactaattacctttaacttactcgttcgacggaacgacgacgacgagaggtaagtaaactaacgtagt

SEQ ID NO: 561088 - DNA, 490 bp, Homo sapiens
  misc_feature: HIJSMM301EBG5A.51.81.H04.1.454.light.4.raw
cgatcgtatacacgaccggtgctcgatttagtagtgtagattcgcggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttggaactgcgaccaagtcaccgtcctgggtcagtccaaggccaacccactgtcta

SEQ ID NO: 561089 - DNA, 508 bp, Homo sapiens
  misc_feature: HIJSMM301CSQE0.3.37.D04.1.454.light.4.raw
agacgcactccacgaccggtgctcgatttagtagcatactgttgggtttggggggggtctcaggaggcagcgctctcgggacgtctccaccatggcctgggctctgctattcctcaccctcctcactcagggcacagggtcctgggcccagtctgccctgagtcagcctgcctccgtgtctgggtctcctggacagtcgatcaccatctcctgcactggaaccagcagtgacgttggtagatataattatgtctcctggtaccaacaactcccaggcaaagcccccaaactgatgatttatgatgtcaataatcggccctcaggggtttctaatcgcttctctggctccaagtctggcaacacggcctccctgaccatctctgggctccagggtgaggacgaggctgattattactgcagctcatttacaagcagcaccactcaggtcttcggaactgggactaaggtcaccgtcctaggtcagcccaaggccaaccccactgtcact

SEQ ID NO: 561090 - DNA, 499 bp, Homo sapiens; identical to SEQ ID NO: 537739
  misc_feature: HIJSMM301BRB41.12.86.H09.1.454.light.4.raw

SEQ ID NO: 561091 - DNA, 485 bp, Homo sapiens; identical to SEQ ID NO: 536576
  misc_feature: HIJSMM301CCWAS.46.35.D02.1.454.light.4.raw

SEQ ID NO: 561092 - DNA, 484 bp, Homo sapiens
  misc_feature: HIJSMM301ANI8A.52.1.A01.1.454.light.4.raw
cgcagtacgacacgaccggtgctcgatttagacgtctcatcaggggagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtggggtcccatcaaggttcagtggcagtggatctgggacagaattcactctcaccatcaccagtctgcaggctgaggattttgcaacttacttctgtcaacagagttacagttccctcactttcggccctcggacgactagtaggatatcaaacgaaactagtggctgcaccaatctgtcttcta

SEQ ID NO: 561093 - DNA, 474 bp, Homo sapiens
  misc_feature: HIJSMM301ELZB4.48.35.D02.1.454.light.4.raw
agtatacatacacgaccggtgctcgatttagcacacgatagttgggtttgggggaggatacgcgtgacagataagaagggctggtgggatcagtcctggtggtagctcaggaagcagagcctggagcatctccactatggcctgggctccactacttctcaccctcctcgctcactgcacaggttcttgggcccattttatgctgactcagccccactctgtgtcggagtctccggggaagacggtgaccatctcctgcacccgcagcagtggcagcgttgccaccaactatgtgcagtggttccagcagcgcccgggcagttcgcccatcactgtgatctatgagaataatgagagaccctctggggtccccgatcggttctctggctccatcgacaggtcctccaactctgcctctctcaccatctctggactgcagactgaggacgaggctgattactactgtcagtctta

SEQ ID NO: 561094 - DNA, 384 bp, Homo sapiens
  misc_feature: HIJSMM301EYJIP.41.26.C04.1.454.light.4.raw
  modified_base (163)..(163): a, c, t, g, unknown or other
tctatactatcacgaccggtgctcgatttagtctagcgactttgggtttgggggaaagagccaccctctcctgcagggccagtgagacagttactgtcaattacttagcctggtaccagcagaagcctggccaggctcccaggctcctcatctctgctgcctncctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 561095 - DNA, 454 bp, Homo sapiens
  misc_feature: HIJSMM301C1UNJ.11.86.H09.1.454.light.4.raw
cgagagataccacgaccggtgctcgatttagtgctatagacttgggtttgggggccgttcctgggcccagtctgtgctgactcagccaccctcagcgtctgggacccccgggcagagggtcatcatctcttgttctggaagcagctctaatatcggaagtaatactgtaaattggtatcaacaactcccaggaacggcccccaaactcctcatctatagtaataatcagcggccctcaggggtccctggccgattctctggctcgaagtctggcacctcagcctccctggcctgcagtgggctccagtctgaggatgaggctgactattattgtgcagcgtgggatgacggtctgagtgctgtggtcttcggcggagggaccaagctgaccgtcctgggtcagcccaaggctgccccctcggtcactctgttcccgccctcctcgtatctctcg

SEQ ID NO: 561096 - DNA, 518 bp, Homo sapiens
  misc_feature: HIJSMM301BAL15.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggacttgggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtgggcaggtcagcccaaggccaaccccactcgtcactctcg

SEQ ID NO: 561097 - DNA, 466 bp, Homo sapiens; identical to SEQ ID NO: 536398
  misc_feature: HIJSMM301A4J7T.3.20.B09.1.454.light.4.raw

SEQ ID NO: 561098 - DNA, 503 bp, Homo sapiens
  misc_feature: HIJSMM301DCTSV.9.12.B01.1.454.light.4.raw
  modified_base (429)..(429): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttcncgggcgttcgccaaggaccaaggtaggaaatacaaacgaactagtggctgcaccatctgtcttcatcttccccg

SEQ ID NO: 561099 - DNA, 486 bp, Homo sapiens; identical to SEQ ID NO: 535043
  misc_feature: HIJSMM301AKX60.46.35.D02.1.454.light.4.raw

SEQ ID NO: 561100 - DNA, 484 bp, Homo sapiens; identical to SEQ ID NO: 535400
  misc_feature: HIJSMM301B7EG1.46.26.C04.1.454.light.4.raw

SEQ ID NO: 561101 - DNA, 487 bp, Homo sapiens; identical to SEQ ID NO: 544897
  misc_feature: HIJSMM301BCUVP.46.35.D02.1.454.light.4.raw

SEQ ID NO: 561102 - DNA, 496 bp, Homo sapiens
  misc_feature: HIJSMM301BM8NF.2.49.E05.1.454.light.4.raw
acgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccgggcagagggtcaccatctcttgttctggaagcatgtccaacatcggaagtgataatgtatactggtaccagcagttcccaagagcggcccccaagctcctcatctatagaaattatgaacggtcctcaggggtccctgaccgattctctggctccaagtctggcacctcagcctccctggccatcagtgggctccggtccgaggatgaggctgattattactgtgttggatgggacagcagcctgagtgcttatgtcttcggaactgggaccacggtcaccgtct

SEQ ID NO: 561103 - DNA, 505 bp, Homo sapiens; identical to SEQ ID NO: 536117
  misc_feature: HIJSMM301BBSFE.8.71.G05.1.454.light.4.raw

SEQ ID NO: 561104 - DNA, 478 bp, Homo sapiens; identical to SEQ ID NO: 535129
  misc_feature: HIJSMM301B3JNX.11.11.A11.1.454.light.4.raw

SEQ ID NO: 561105 - DNA, 500 bp, Homo sapiens
  misc_feature: HIJSMM301E0GHW.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtctgcgtcagcccaaggctcgccccctggtcact

SEQ ID NO: 561106 - DNA, 463 bp, Homo sapiens; identical to SEQ ID NO: 535062
  misc_feature: HIJSMM301DUVHE.11.73.G07.1.454.light.4.raw

SEQ ID NO: 561107 - DNA, 507 bp, Homo sapiens; identical to SEQ ID NO: 538063
  misc_feature: HIJSMM301AHOGH.47.85.H08.1.454.light.4.raw

SEQ ID NO: 561108 - DNA, 484 bp, Homo sapiens; identical to SEQ ID NO: 537891
  misc_feature: HIJSMM301D3X94.10.1.A01.1.454.light.4.raw

SEQ ID NO: 561109 - DNA, 457 bp, Homo sapiens; identical to SEQ ID NO: 536586
  misc_feature: HIJSMM301A04G2.49.85.H08.1.454.light.4.raw

SEQ ID NO: 561110 - DNA, 495 bp, Homo sapiens; identical to SEQ ID NO: 535143
  misc_feature: HIJSMM301ERVS2.51.29.C07.1.454.light.4.raw

SEQ ID NO: 561111 - DNA, 518 bp, Homo sapiens
  misc_feature: HIJSMM301DAF5S.27.23.C01.1.454.light.4.raw
agcgtcgtctcacgaccggtgctcgatttagtacacgtgattagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagccaaggctgccccctcggtcactctgttcccgcct

SEQ ID NO: 561112 - DNA, 494 bp, Homo sapiens; identical to SEQ ID NO: 534992
  misc_feature: HIJSMM301BO3J9.9.1.A01.1.454.light.4.raw

SEQ ID NO: 561113 - DNA, 491 bp, Homo sapiens; identical to SEQ ID NO: 535194
  misc_feature: HIJSMM301DZ7O6.26.78.H01.1.454.light.4.raw

SEQ ID NO: 561114 - DNA, 493 bp, Homo sapiens; identical to SEQ ID NO: 535199
  misc_feature: HIJSMM301BTPP0.16.86.H09.1.454.light.4.raw

SEQ ID NO: 561115 - DNA, 488 bp, Homo sapiens; identical to SEQ ID NO: 542699
  misc_feature: HIJSMM301ETPO7.12.51.E07.1.454.light.4.raw

SEQ ID NO: 561116 - DNA, 489 bp, Homo sapiens
  misc_feature: HIJSMM301CE329.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccgggtgggggctgaggatgttggcatttattactgcatgcaggctatacaccttcctgcctacttttggccaggggaccaagctggagatcaggcgaacg

SEQ ID NO: 561117 - DNA, 499 bp, Homo sapiens; identical to SEQ ID NO: 537739
  misc_feature: HIJSMM301D69U8.12.86.H09.1.454.light.4.raw

SEQ ID NO: 561118 - DNA, 383 bp, Homo sapiens
  misc_feature: HIJSMM301C0EY6.41.26.C04.1.454.light.4.raw
tctatactatcacgaccggtgctcgatttagtctagcgactttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccattagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 561119 - DNA, 484 bp, Homo sapiens
  misc_feature: HIJSMM301DC1RO.49.57.F02.1.454.light.4.raw
agtcgagagacacgaccggtgctcgatttagctcgatatagttgggtttgggggctgtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagactttgagagggcctcagggacccctgagcgattctctggctccagctcagcgacaacagtcacgttgaccatcagtggagtccgggcagaggacgaggctgactattactgtcagtcatcagacagtagtggcacttctgtcgtattcggcggagggaccaagctgaccgtcctaggtcagcccaac

SEQ ID NO: 561120 - DNA, 503 bp, Homo sapiens
  misc_feature: HIJSMM301BESR7.18.78.H01.1.454.light.4.raw
tacgagtatgcacgaccggtgctcgatttagtgtgagtagtttgggtttgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcataatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaacccactgtca

SEQ ID NO: 561121 - DNA, 494 bp, Homo sapiens
  misc_feature: HIJSMM301AMS85.49.66.F11.1.454.light.4.raw
agtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccagccaggttcagtggcagtgggtttgggacagacttcacgctcaccatcagcagcctagagcctgaagattttgcagtttattactgtcaacagcgtaccacaggattcactttcggccctgggaccagagtggatatcaaacgaaactgtggctgcaccatctgtcttcatcttcccg

SEQ ID NO: 561122 - DNA, 462 bp, Homo sapiens
  misc_feature: HIJSMM301DEC7I.11.73.G07.1.454.light.4.raw
cgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcagttgccaggcgagtcaggacattaagaactatttaaattggtatcggcagcgaccagggaaagcccctgagctcctgatctacgatgcgtccaatttggaaacagaggtcccaccgaggttcagtggaagtggatctgggacagactttactctcaccatcagcagcctgcagcctgaagatattgcaacatattactgtcaacagtatgatcgtctcctcaatttcggccctgggaccagagtggacatgaacgaa

SEQ ID NO: 561123 - DNA, 495 bp, Homo sapiens; identical to SEQ ID NO: 535007
  misc_feature: HIJSMM301CVV6G.22.5.A05.1.454.light.4.raw

SEQ ID NO: 561124 - DNA, 489 bp, Homo sapiens; identical to SEQ ID NO: 535139
  misc_feature: HIJSMM301CSU6N.14.55.E11.1.454.light.4.raw

SEQ ID NO: 561125 - DNA, 505 bp, Homo sapiens
  misc_feature: HIJSMM301AJTY3.11.67.G01.1.454.light.4.raw
cgagagataccacgaccggtgctcgatttagagtatacatattgggtttggggggttgagaagacaggactcaggacaatctccagcatggccagcttccctctcctcctcaccctcctcactcactgtgcagggtcctgggcccagtctgttctgactcagccaccctcagcgtctgggacccccgggcagagaatcaccatctcttgtactggaagcagctccaatatcggaagtaacgatgtcaattggtatcaacatctccccggtacggcccccaaactcctcatctataggaatagccagcggccctcaggggtccctggtcgattctctggctcgaagtctggcacctcagcctccctggcctgcagtgggctccagtctgaggatgaggctgactattattgtgcagcgtgggatgacggtctgagtgctgtggtcttcggcggagggaccaagctgaccgtcctgggtcagcccaaggctgccccctcggtcactc

SEQ ID NO: 561126 - DNA, 492 bp, Homo sapiens
  misc_feature: HIJSMM301CSG8X.43.29.C07.1.454.light.4.raw
tgtgagtagtcacgaccggtgctcgatttagagtgctacgaagggaaagggggagtcagacccactcaggacacagcatggacatgagggtccccgctcagctcctggggcttctgctgctctggctcccaggtgccagatgtgccatccagttgacccagtctccatcctccctgtctgcatcagtaggagacagagtcaccatcacttgccgggcaagtcagggcattggaaccgctttagcctggtatctgcagaacccagggaaagctcctaagctcctcatctctggtgcctccactttggaaagtggggtcccatcaagattcagcggtagtggatctgggacagaattcactctcaccgtcagcagcctgcagcctgaagattttgcaacttattactgtcaacagtttaataactaccctctcactttcggagagggaccagggtggagatcaaacgaactgtggctgcaccatctgtcttcta

SEQ ID NO: 561127 - DNA, 478 bp, Homo sapiens; identical to SEQ ID NO: 535129
  misc_feature: HIJSMM301CZTDB.11.11.A11.1.454.light.4.raw

SEQ ID NO: 561128 - DNA, 447 bp, Homo sapiens; identical to SEQ ID NO: 535020
  misc_feature: HIJSMM301C8GTM.18.9.A09.1.454.light.4.raw

SEQ ID NO: 561129 - DNA, 489 bp, Homo sapiens; identical to SEQ ID NO: 535139
  misc_feature: HIJSMM301C11MJ.14.55.E11.1.454.light.4.raw

SEQ ID NO: 561130 - DNA, 444 bp, Homo sapiens; identical to SEQ ID NO: 535594
  misc_feature: HIJSMM301DN7UC.9.9.A09.1.454.light.4.raw

SEQ ID NO: 561131 - DNA, 503 bp, Homo sapiens
  misc_feature: HIJSMM301C2YNG.14.86.H09.1.454.light.4.raw
cgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccaggggaaagagccaccctctcctgcagggccagtcagagtgttagcacctccttagcctggtaccaacagaaacctggccaggctcccagcctcctcatctctgatgcttccaacagggccactggcatcccagccaggttcagtggcagtgggtctgggacagacttcactctcaccatcagctccctagagcctggagattttgtagtttattactgtcagcagtatagcagctggcctccactttcggcggagggaccaaggtggagatccaacgaactgtggctgcaccatctgtcttcatcttccccg

SEQ ID NO: 561132 - DNA, 493 bp, Homo sapiens; identical to SEQ ID NO: 535745
  misc_feature: HIJSMM301DSABI.47.78.H01.1.454.light.4.raw

SEQ ID NO: 561133 - DNA, 514 bp, Homo sapiens
  misc_feature: HIJSMM301DYP98.17.33.C11.1.454.light.4.raw
  modified_base (508)..(508): a, c, t, g, unknown or other
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctcgccccctcggtcactctcgttcccncctcct

SEQ ID NO: 561134 - DNA, 494 bp, Homo sapiens; identical to SEQ ID NO: 534992
  misc_feature: HIJSMM301DIY4J.9.1.A01.1.454.light.4.raw

SEQ ID NO: 561135 - DNA, 479 bp, Homo sapiens; identical to SEQ ID NO: 535586
  misc_feature: HIJSMM301BS5A2.13.34.D01.1.454.light.4.raw

SEQ ID NO: 561136 - DNA, 447 bp, Homo sapiens; identical to SEQ ID NO: 535882
  misc_feature: HIJSMM301AU67C.18.9.A09.1.454.light.4.raw
  modified_base (429)..(429): a, c, t, g, unknown or other

SEQ ID NO: 561137 - DNA, 502 bp, Homo sapiens
  misc_feature: HIJSMM301CN0WD.40.23.C01.1.454.light.4.raw
tctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtcttagcaactacttagtctggtaccaacaagaaacctggccaggctcccaggctcctcatctatgatgcatccagcagggccactggcatcccagccaggttcagtggcagtgggtctgggacagacttcactctcaccatcagcggcctagagcctgaagactttgctagtttattactgtcagcagcgtaccaactggccgctcactttcggcgggagggaccgaaggtggagatacaaacgaactgtggctgcaccatctgtcttcatt

SEQ ID NO: 561138 - DNA, 386 bp, Homo sapiens
  misc_feature: HIJSMM301CUEB1.21.40.D07.1.454.light.4.raw
tcgtcgctcgcacgaccggtgctcgatttagtgatagagcgtaacaacagagggtcaccatcccttgttctggaagcagctccaacatcggaagacattatgtgtactggtaccagcagctcccaggaacggcccccaaactcctcatctataggaataatcagcggccctcaggggtccctgaccgattctctggctccaattctggcacctcagcctccctggccatcagtgggctccggtccgaggatgaggctgattattactgtgcagcatgtgatgacggcctgagtggtccggtgttcggcggagggaccaggctgaccgtcctaggtcagcccaaggctgcccctcggtcactctgttcccacctcctccgagcgaca

SEQ ID NO: 561139 - DNA, 478 bp, Homo sapiens
  misc_feature: HIJSMM301DVM0H.5.12.B01.1.454.light.4.raw
atcagacacgcacgaccggtgctcgatttagtagtgtagattccgcgggggcccactgttagggctcaggggctgtgtccaccatggcctggactcttctccttctcgtgctcctctctcactgcacaggttccctctcccagcctgtgctgactcagccatcttcccattctgcatcttctggagcatcagtcagactcacctgcatgctgagcagtggcttcagtgttggggacttctggataaggatatcagaggctgattgcagagtcaccttatagatcacttcatagacacagggaacagaagacacagacaactgaggaagcaaagtttaaattctactcacgtttgatttccaccttggtcccttggccgaacgtcctcgggtgttcggcggagggaccaagctgaccgtcctaggtcagcccaaggctgccccctcggtcactctgttcccgcctcctccgtgtctgat

SEQ ID NO: 561140 - DNA, 461 bp, Homo sapiens
  misc_feature: HIJSMM301DF2O0.11.73.G07.1.454.light.4.raw
cgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctgatctacgatgcgtccaatttggaaacagaggtcccaccgaggttcagtggaagtggatctgggacagactttactctcaccatcagcagcctgcagcctgaagatattgcaacatattactgtcaacagtatgatcgtctcctcaatttcggcctgggaccagagtggacatgaaacga

SEQ ID NO: 561141 - DNA, 501 bp, Homo sapiens; identical to SEQ ID NO: 536142
  misc_feature: HIJSMM301ER1G5.15.1.A01.1.454.light.4.raw

SEQ ID NO: 561142 - DNA, 503 bp, Homo sapiens
  misc_feature: HIJSMM301C4N1P.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtggaatacaaacgaactagtggctgcaccatctgtcttcatcttccccg

SEQ ID NO: 561143 - DNA, 478 bp, Homo sapiens
  misc_feature: HIJSMM301EUW4O.41.68.G02.1.454.light.4.raw
tctatactatcacgaccggtgctcgatttagtcgatagtgaagggaaagggggcaggagtcagtcccaaccaggacacagcatggacatgagggtccctgctcagctcctggggctcctgctgctctggctctcaggtgccagatgtgacatccagatgacccagtctccaacctccctgtctgcatctgtaggagacagagtcaccatcacttgccaggccagtcaggacattagcaactatttaaattggtatcagcagaaaccagggaaagcccctaagctcctgatctacgatgcatccaatttggaatcaggggtcccatcaaggttcagtggaagtggatctgggacagattttactttcaccatcaccagcctgcagcctgaagatattgcaacatattactgtcaacagtatgataatctccctcccactttcggcggagggaccaaggtggagatcaaacgaactgtgg

SEQ ID NO: 561144 - DNA, 505 bp, Homo sapiens; identical to SEQ ID NO: 538422
  misc_feature: HIJSMM301DCNSA.19.78.H01.1.454.light.4.raw

SEQ ID NO: 561145 - DNA, 419 bp, Homo sapiens
  misc_feature: HIJSMM301EG7EA.9.34.D01.1.454.light.4.raw
tgatacgtctcacgaccggtgctcgatttagatcgtctgtgttgggtttggggctgttcctggaagttgttggtaccagagggtcaccatctcgtgcactggaagtagctccaacatcggggcacgttatgatgtacactggtaccaacaacttccaggaacagccccaaagtcatcatttatgacaacatgaagcggccctcaggggtccctgaccgattctccggctccaagtctggcacatcagcctccctggccatcactgggctccaggctgaggatgaggctgactattactgccagtcgtatgacagtggcctaagtaacatcgtcttcggaactgggaccaaggtcaccgtcctgggtcagcccaaggccaacccactgtcactctgttcccgccctcctcagacgtatca

SEQ ID NO: 561146 - DNA, 481 bp, Homo sapiens; identical to SEQ ID NO: 545917
  misc_feature: HIJSMM301BR0U1.52.5.A05.1.454.light.4.raw

SEQ ID NO: 561147 - DNA, 497 bp, Homo sapiens
  misc_feature: HIJSMM301AO6HJ.13.6.A06.1.454.light.4.raw
tcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcgggcctccggggtccctaacaggttcagtggcagtggatcaggcacagattttacactgaaaatcagcagagtggaggctgaggatgttggggtttattactgcatgcaagctctacaacctctgcggactttcggccctgggaccaaacgtggagatcaaacgaaactgtggctgcaccactctgtctt

SEQ ID NO: 561148 - DNA, 490 bp, Homo sapiens
  misc_feature: HIJSMM301DDABG.16.72.G06.1.454.light.4.raw
tgtactactccacgaccggtgctcgatttagctacgactgcaagggaaagggggaggaactgctcagttaggacccagacggaaccatggaagccccagcgcagcttctcttcctcctgctactctggctcccagatacctctggagaaacagtgatgacgcagtctccagccaccctctctgtgtctccaggggaaagagtcaccctctcctgcagggccagtcagagtgttagcagcaacttagcctggtatcagcagaaacctggccaggctcccaggctcctcatctatgatgcatccaccagggccactggtatcccagccaggttcagtggcagtgggtttgggacagagttcactctcaccatcagcagcctgcagtctgaagattttgcagtttattactgtcagcagtataataactggcctccggtcactttcggcggagggaccaaggtggagatcaaacggaactgtggctgcaccat

SEQ ID NO: 561149 - DNA, 501 bp, Homo sapiens
  misc_feature: HIJSMM301BEB0X.53.81.H04.1.454.light.4.raw
cgcgtatacacacgaccggtgctcgatttagtagtgtagattcgcggggagcttcagctgtggtagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcctgttctggaagcaggtccaacatcggaagtgattttgtattctggtaccagctgctcccaggagcgggccccaaactcctcatttacaggaatgatcagcggccctcaggggtccctgaccgattctctggctccaagtctggcacctcagcctccctggccatcagtggcctccggtccgacgatgaggctgattattattgtgcagcatgggatgacagcctgagtggtgtggtaattcggcggagggaccaagctgaccgtcctaggtcagcccaaggctccg

SEQ ID NO: 561150 - DNA, 497 bp, Homo sapiens; identical to SEQ ID NO: 538296
  misc_feature: HIJSMM301ENOF3.18.11.A11.1.454.light.4.raw

SEQ ID NO: 561151 - DNA, 513 bp, Homo sapiens
  misc_feature: HIJSMM301DZ1BN.13.38.D05.1.454.light.4.raw
tcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcggtccacggaccgaacggtaggaaagtacaagacgaacgtagtggcgtgcgaccatctgtcttctatcttcccgt

SEQ ID NO: 561152 - DNA, 520 bp, Homo sapiens; identical to SEQ ID NO: 539176
  misc_feature: HIJSMM301BYRZ2.27.23.C01.1.454.light.4.raw

SEQ ID NO: 561153 - DNA, 488 bp, Homo sapiens
  misc_feature: HIJSMM301DIKOL.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggggacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaaggtggagatcaaacgaactgt

SEQ ID NO: 561154 - DNA, 503 bp, Homo sapiens
  misc_feature: HIJSMM301BAMJS.41.18.B07.1.454.light.4.raw
tctatactatcacgaccggtgctcgatttagtcgctgcgtaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtggttcggtcggggggaccgaacgctgaccgtcctaggtcagcccaaggctgccccctccggtcactctcgtt

SEQ ID NO: 561155 - DNA, 500 bp, Homo sapiens
  misc_feature: HIJSMM301BVNA5.48.41.D08.1.454.light.4.raw
agtatacatacacgaccggtgctcgatttagtcacgcgagaaagggaaaggggggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagttacgtcggaccttcggccaagggacacgactggagattaaacgaactgtggctgcaccatctgtcttcatcttcccg

SEQ ID NO: 561156 - DNA, 495 bp, Homo sapiens
  misc_feature: HIJSMM301EVWUS.41.82.H05.1.454.light.4.raw
tctatactatcacgaccggtgctcgatttagtcgagctctctcgcgggagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgccgggccagtcagagtattagtacctggttggcctggtatcagcagaaaccagggaaagcccctaagttcctgatctataaggcgtctagtttagaaagtggggtcccatcaaggatcagcggcagtggatctgggacagaattcactctcaccattagtagcctgcagcctgatgattttgcaacttattactgccaacaatataatgattttccgtggacgttcggccaagggaccaaggtagaaatcaaacgaactgtggctgcaccatctgtcttcatcttcccgccta

SEQ ID NO: 561157 - DNA, 484 bp, Homo sapiens; identical to SEQ ID NO: 535400
  misc_feature: HIJSMM301BUEW8.46.26.C04.1.454.light.4.raw

SEQ ID NO: 561158 - DNA, 488 bp, Homo sapiens; identical to SEQ ID NO: 537124
  misc_feature: HIJSMM301EHP0C.11.25.C03.1.454.light.4.raw

SEQ ID NO: 561159 - DNA, 504 bp, Homo sapiens
  misc_feature: HIJSMM301DW767.49.73.G07.1.454.light.4.raw
agtcgagagacacgaccggtgctcgatttagctctacgctcagggcacgaccggtgctcgatttagtcgctgcgtaaaggagaaagggggaggaactgctcagttaggacccagagggaaccatggaagccccagctcagcttctcttcctcctgcttctctggctcccagatattaccggagaaattgtgttgacgcagtctccagccaccctgtctttgtctccaggggaaagagccaccctctcctgcagggccagtcagagtgttaacatctacttagtctggtaccaacagaaagctggccacgctcccaggctcctcatctatgatacatccaccagggcccctggcatcccagccaggttcagtggcagtgggtctgggacagacttcactctcaccatcagcagcttagagcctgaagattttgcagtttattactgtcagcagcgtatcaccgggatcaccttcggccaagggacccgactggagattaagcgaa

SEQ ID NO: 561160 - DNA, 503 bp, Homo sapiens; identical to SEQ ID NO: 535044
  misc_feature: HIJSMM301CI82T.19.78.H01.1.454.light.4.raw

SEQ ID NO: 561161 - DNA, 484 bp, Homo sapiens; identical to SEQ ID NO: 539003
  misc_feature: HIJSMM301EKW3Q.10.1.A01.1.454.light.4.raw

SEQ ID NO: 561162 - DNA, 493 bp, Homo sapiens
  misc_feature: HIJSMM301EKTQX.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgcagtttattactgtcagcagtataattactggcctcggacgttcggccaaggaccgaaggtaggaagtacaacgaactagtggctgcaccatctgtctt

SEQ ID NO: 561163 - DNA, 447 bp, Homo sapiens; identical to SEQ ID NO: 535201
  misc_feature: HIJSMM301DKFEW.18.9.A09.1.454.light.4.raw

SEQ ID NO: 561164 - DNA, 503 bp, Homo sapiens
  misc_feature: HIJSMM301DGLJT.40.67.G01.1.454.light.4.raw
tctagcgactcacgaccggtgctcgatttagagtatacatattgggtttggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaagcctggccaggctcccagactcctcatctatgatgcgtcttccagggccactggcgtcccggccaggttcagtggcagtgggtctgggacagccttcactctcaccatcagcagcctggagcccgaagattttgcggtttattactgtcagcagcgtgccgactggccccctcacgttcggcggagggaccaaggtggacatcaaacgactgtggctgcaccatctgtcttcatcttcccgcc

SEQ ID NO: 561165 - DNA, 493 bp, Homo sapiens; identical to SEQ ID NO: 535745
  misc_feature: HIJSMM301AYVKN.47.78.H01.1.454.light.4.raw

SEQ ID NO: 561166 - DNA, 504 bp, Homo sapiens; identical to SEQ ID NO: 538940
  misc_feature: HIJSMM301CYCPG.2.35.D02.1.454.light.4.raw

SEQ ID NO: 561167 - DNA, 513 bp, Homo sapiens
  misc_feature: HIJSMM301BNJTG.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggcacggacgaacggtaggaagtacgaacgaactacgtggcgtgcaccactctgtcttctatcttcccgtcctact

SEQ ID NO: 561168 - DNA, 490 bp, Homo sapiens; identical to SEQ ID NO: 535526
  misc_feature: HIJSMM301BXWSF.26.78.H01.1.454.light.4.raw

SEQ ID NO: 561169 - DNA, 504 bp, Homo sapiens
  misc_feature: HIJSMM301AXNDT.43.59.F04.1.454.light.4.raw
tgtgagtagtcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaaccccactgt

SEQ ID NO: 561170 - DNA, 479 bp, Homo sapiens; identical to SEQ ID NO: 542895
  misc_feature: HIJSMM301BBZW3.40.59.F04.1.454.light.4.raw

SEQ ID NO: 561171 - DNA, 514 bp, Homo sapiens; identical to SEQ ID NO: 544770
  misc_feature: HIJSMM301DB2CX.16.66.F11.1.454.light.4.raw

SEQ ID NO: 561172 - DNA, 486 bp, Homo sapiens
  misc_feature: HIJSMM301CWUSX.52.73.G07.1.454.light.4.raw
cgcagtacgacacgaccggtgctcgatttagctctacgctcaggggactgatcaggactcctcagttcaccttctcacaatgaggctccctgctcagctcctggggctgctaatgctctgggtctctggatccagtggggagattgtgatgactcagtctccactctccctgcccgtcacccctggagagacggcctccatctcctgcaggtctagtcagagcctcctgcatagtaatggatacaagtatttggattggtatctgcagaagccagggcagtctccacagctcctgatctatttgggttctaatcgggcctccggggtccctgagaggttcagtggcagtggatcaggcacagattttacactaaaaatcagcagagtggaggctgaggatgttggggtttattacttgcatgcaagttctacaaaatcctcgcacttttggccaggggaccaagctggagatcaaacgaactgtgg

SEQ ID NO: 561173 - DNA, 509 bp, Homo sapiens; identical to SEQ ID NO: 543266
  misc_feature: HIJSMM301AHPR4.17.33.C11.1.454.light.4.raw

SEQ ID NO: 561174 - DNA, 475 bp, Homo sapiens
  misc_feature: HIJSMM301ESKLB.5.15.B04.1.454.light.4.raw
atcagacacgcacgaccggtgctcgatttagacagtatatatccgcgggggagtcagactcagtcaggacacagcatggacatgagggtccccgctcagctcctggggctcctgctgctctggctcccaggtgccaaatgtgacatccagatgacccagtctccttccaccctgtctgcatctataggagacagagtcaccatcacttgccgggccagtcagagtattagtaactggttggcctggtatcagcagaaaccaggcaaagccccaaagctccttatctctgatgcctccactttgcacggtggggtcccaccaacgttcagcggcagtggatctgggacagaattcactctcaccatcagcagcctgcagcctgatgatgctgcaacttattactgtcaacaatataacagttatggacttcggccaagggaccaaggtggaaatcaaacgaactgtggctgcacca

SEQ ID NO: 561175 - DNA, 465 bp, Homo sapiens
  misc_feature: HIJSMM301CNRTC.13.4.A04.1.454.light.4.raw
tcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacaggggtcccatcaaggttcagtggaagtggatctgggacagattttactttcaccatcagcagcctgcagcctgaagatattgcaacatattactgtcagcagtatgataatctcccgatcaccttcggccaagggcacgactggagattaaacgaa

SEQ ID NO: 561176 - DNA, 486 bp, Homo sapiens; identical to SEQ ID NO: 540090
  misc_feature: HIJSMM301ADXCB.17.36.D03.1.454.light.4.raw

SEQ ID NO: 561177 - DNA, 489 bp, Homo sapiens; identical to SEQ ID NO: 535139
  misc_feature: HIJSMM301AXCOU.14.55.E11.1.454.light.4.raw

SEQ ID NO: 561178 - DNA, 495 bp, Homo sapiens
  misc_feature: HIJSMM301B722X.52.38.D05.1.454.light.4.raw
cgcagtacgacacgaccggtgctcgatttagtatctgatagttgggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccatttgtacttatgtcttcggaactgcgaccaaggtcaccgtcctgggtcagcccaaggccaaccccactgt

SEQ ID NO: 561179 - DNA, 454 bp, Homo sapiens; identical to SEQ ID NO: 535005
  misc_feature: HIJSMM301EGYVQ.19.86.H09.1.454.light.4.raw

SEQ ID NO: 561180 - DNA, 501 bp, Homo sapiens
  misc_feature: HIJSMM301AEMTG.22.27.C05.1.454.light.4.raw
acatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttattttttacagctccaccaataagagctacttagcttggttccagcagaaaccaggacatcctcctctactgctcatttactgggcgtctacccgggaagtccggggtccctgaccgattcagtggcagcgggtctgggacagatttcactctcaccatcagcagcctgcaggctgaagatgtggcagttttattactgtcagcaatattatattcctcctcagacgttcggccaagggaccaaggtaggaaatacaaacgaactgtggctgcacc

SEQ ID NO: 561181 - DNA, 473 bp, Homo sapiens; identical to SEQ ID NO: 559852
  misc_feature: HIJSMM301CXZLJ.3.38.D05.1.454.light.4.raw

SEQ ID NO: 561182 - DNA, 474 bp, Homo sapiens
  misc_feature: HIJSMM301CCD01.51.35.D02.1.454.light.4.raw
cgatcgtatacacgaccggtgctcgatttagcacacgatagttgggtttggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagagaccagggaaagcccctaacctcctgatctatgatgcatccaatttggaaagtggggtcccatcaaggttcagtggcagtggatctgggacagatttcactctcaccatcagcagtgtgcgacctgaagattttgcaacttactactgtcaacagagttacagtacccctcagctcactttcggcggagggaccaaggtggagatacaaacgaa

SEQ ID NO: 561183 - DNA, 497 bp, Homo sapiens
  misc_feature: HIJSMM301CO58W.19.71.G05.1.454.light.4.raw
  modified_base (476)..(476): a, c, t, g, unknown or other
tactctcgtgcacgaccggtgctcgatttagtgtcgtcgcaagagagagggggaggtacaacaggcaggcaggggcgagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggtccaagggaccaaggtggntaatcagacgaactagtggct

SEQ ID NO: 561184 - DNA, 485 bp, Homo sapiens; identical to SEQ ID NO: 536630
  misc_feature: HIJSMM301AIARB.13.56.F01.1.454.light.4.raw

SEQ ID NO: 561185 - DNA, 489 bp, Homo sapiens; identical to SEQ ID NO: 535139
  misc_feature: HIJSMM301CB1E1.14.55.E11.1.454.light.4.raw

SEQ ID NO: 561186 - DNA, 492 bp, Homo sapiens
  misc_feature: HIJSMM301BWSTM.49.86.H09.1.454.light.4.raw
agtcgagagacacgaccggtgctcgatttagtgctatagacttgggtttgggggaggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgggacagacttcactctcaccatcagcagcctagagcctgaagattttgcagtctattactgtcagcagcgttacaactggcctcccatgtacacttttggccaggggaccaagctggaaatcagacgaactgtggctgcaccat

SEQ ID NO: 561187 - DNA, 487 bp, Homo sapiens; identical to SEQ ID NO: 536025
  misc_feature: HIJSMM301CHY6Q.17.34.D01.1.454.light.4.raw

SEQ ID NO: 561188 - DNA, 460 bp, Homo sapiens; identical to SEQ ID NO: 545790
  misc_feature: HIJSMM301AGDO8.22.28.C06.1.454.light.4.raw
  modified_base (442)..(442): a, c, t, g, unknown or other

SEQ ID NO: 561189 - DNA, 485 bp, Homo sapiens; identical to SEQ ID NO: 536263
  misc_feature: HIJSMM301BSJLM.47.78.H01.1.454.light.4.raw

SEQ ID NO: 561190 - DNA, 484 bp, Homo sapiens; identical to SEQ ID NO: 535240
  misc_feature: HIJSMM301DAQVU.47.60.F05.1.454.light.4.raw

SEQ ID NO: 561191 - DNA, 502 bp, Homo sapiens; identical to SEQ ID NO: 545036
  misc_feature: HIJSMM301C3DLP.15.57.F02.1.454.light.4.raw

SEQ ID NO: 561192 - DNA, 488 bp, Homo sapiens
  misc_feature: HIJSMM301C9KY2.21.55.E11.1.454.light.4.raw
tcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattatttgccggacaagtcacgacataaacacctttttaaattggtatcagcacaaaccagggaaggccccaaagctcctgatcgatgctgcatccaatttagagagtggggtcccatccaggttcagtggcgatggatctgggacaaatttcactctcaccatcagcagtctgcaacctgaagattttgcaacttactattgtcaacagagttacagtattcctttcactttcggccctgggaccgaagtcgatatcaaacgaactgtggctgcaccatctgtt

SEQ ID NO: 561193 - DNA, 479 bp, Homo sapiens
  misc_feature: HIJSMM301DVXFQ.16.81.H04.1.454.light.4.raw
tgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaactttcggccctgggaccaatgtggatatcaacgaactgtggctgcacatctgt

SEQ ID NO: 561194 - DNA, 488 bp, Homo sapiens; identical to SEQ ID NO: 537673
  misc_feature: HIJSMM301AXZEB.12.31.C09.1.454.light.4.raw

SEQ ID NO: 561195 - DNA, 517 bp, Homo sapiens; identical to SEQ ID NO: 536262
  misc_feature: HIJSMM301ARJ2K.14.70.G04.1.454.light.4.raw

SEQ ID NO: 561196 - DNA, 490 bp, Homo sapiens; identical to SEQ ID NO: 535526
  misc_feature: HIJSMM301B0EQ9.26.78.H01.1.454.light.4.raw

SEQ ID NO: 561197 - DNA, 504 bp, Homo sapiens
  misc_feature: HIJSMM301E17GU.3.79.H02.1.454.light.4.raw
agacgcactccacgaccggtgctcgatttagtgtcacacgaagggaaaggggggggtcgtcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttatatctctgtctcctggtaccaacaacacccaggcaaagcccccaaactcatcatttatgatgtcactgctcggccctcaggggtttctcatcgcttttctggctccaagtctggcaccaggcctccctgaccatctcggggctccaggctgaggacgaggctgcttattactgcagctcatatacaaggagcaccactctcgtggtatttggtggaggaccaagctgaccgtctaggtcagcccaaggctgccccctcggt

SEQ ID NO: 561198 - DNA, 502 bp, Homo sapiens
  misc_feature: HIJSMM301BMVIU.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgactgactcagtctccgctctccccgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccaagggaccaaggtggaaatcaaacgaactagtggctgcaccat

SEQ ID NO: 561199 - DNA, 448 bp, Homo sapiens
  misc_feature: HIJSMM301A5AK3.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccaccctcctcccatactcgta

SEQ ID NO: 561200 - DNA, 484 bp, Homo sapiens
  misc_feature: HIJSMM301A367Q.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacaggctgcccccaaccttcggccaggggacacgactggagataaacgaactgtggctgcaccatctgt

SEQ ID NO: 561201 - DNA, 493 bp, Homo sapiens; identical to SEQ ID NO: 539456
  misc_feature: HIJSMM301AOWMT.10.79.H02.1.454.light.4.raw

SEQ ID NO: 561202 - DNA, 488 bp, Homo sapiens; identical to SEQ ID NO: 537260
  misc_feature: HIJSMM301BRYX9.47.70.G04.1.454.light.4.raw

SEQ ID NO: 561203 - DNA, 487 bp, Homo sapiens; identical to SEQ ID NO: 543166
  misc_feature: HIJSMM301AERU6.5.23.C01.1.454.light.4.raw

SEQ ID NO: 561204 - DNA, 510 bp, Homo sapiens; identical to SEQ ID NO: 535855
  misc_feature: HIJSMM301AMG9G.17.33.C11.1.454.light.4.raw

SEQ ID NO: 561205 - DNA, 504 bp, Homo sapiens
  misc_feature: HIJSMM301ATK4R.10.43.D10.1.454.light.4.raw
catagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctcgggaccaaagtaggatatcaaacgaactagtggctgcaccatctgtcttcat

SEQ ID NO: 561206 - DNA, 511 bp, Homo sapiens
  misc_feature: HIJSMM301AQF4Z.16.46.E02.1.454.light.4.raw
tgtactactccacgaccggtgctcgatttagactcatctacagggaaaggggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaattacttttgtcttcggaactgggaccaaggtcaccgtctaggtcagcccaaggcccaaccccactgtcactctcg

SEQ ID NO: 561207 - DNA, 501 bp, Homo sapiens; identical to SEQ ID NO: 538461
  misc_feature: HIJSMM301CSNXM.13.11.A11.1.454.light.4.raw

SEQ ID NO: 561208 - DNA, 503 bp, Homo sapiens; identical to SEQ ID NO: 537216
  misc_feature: HIJSMM301C7PI2.3.70.G04.1.454.light.4.raw

SEQ ID NO: 561209 - DNA, 494 bp, Homo sapiens; identical to SEQ ID NO: 534994
  misc_feature: HIJSMM301BZ2GG.27.78.H01.1.454.light.4.raw

SEQ ID NO: 561210 - DNA, 515 bp, Homo sapiens
  misc_feature: HIJSMM301CZ6XM.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctcggacccctgcccgattctcaggctccctccgttggggcaaagctgccctgacactgtctggtgtgcagcctgaggacgaggctgactattactgcctactctactttggtggtgctgtgctattcggcggagggaccaagctgaccgtcttaagtcagcccaaggctcgccccctcggtccactctcgttcccgt

SEQ ID NO: 561211 - DNA, 495 bp, Homo sapiens
  misc_feature: HIJSMM301CP29C.26.72.G06.1.454.light.4.raw
  modified_base (474)..(474): a, c, t, g, unknown or other
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatatttcgtgctccgtacacttttggccaggggacccaggtggaggatcagacgaactgtggctgcnccatctgtcttcatcttcccg

SEQ ID NO: 561212 - DNA, 498 bp, Homo sapiens
  misc_feature: HIJSMM301CDC52.11.59.F04.1.454.light.4.raw
  modified_base (480)..(480): a, c, t, g, unknown or other
cgagagataccacgaccggtgctcgatttagtacacacacttagggattgggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagcccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctactcttttctcttcggaactgggaccacggtcaccgtcctaggtcagcccaaggccaaccccactgtcactctgttcccnccctcctcgtatctctcg

SEQ ID NO: 561213 - DNA, 477 bp, Homo sapiens
  misc_feature: HIJSMM301ETZTB.12.1.A01.1.454.light.4.raw
atacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaaggttcagtggcagtgggtctgggacagatttcactctcaccatcagcagtctgcaactgaagattctgcaacttattactgtcaacagagtaacagttaccctcccactttcggcggagggaccgaaggtggagatacaaacgaactgtggctgcacatctgtt

SEQ ID NO: 561214 - DNA, 454 bp, Homo sapiens; identical to SEQ ID NO: 536347
  misc_feature: HIJSMM301BW6PO.19.86.H09.1.454.light.4.raw

SEQ ID NO: 561215 - DNA, 512 bp, Homo sapiens
  misc_feature: HIJSMM301CE8E5.16.83.H06.1.454.light.4.raw
tgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtggccccaggacagacggccagcataacctgtgggggaaacggccttggacgtaaaagtgtgcactggtaccagcagaagccaggccaggcccctgtgctggtcgtctatgatgatagcgaccggccctcagggatccctgagcgattctctggctccaactctgggaacgcggccaccctgaccatcagcagggtcgaagccggggatgaggccgactattactgtcaggtgtgggatagtagtagtgatcattatgtcttcggatctgggaccagggtcaccgtcctaggtcagcccaaggccaaccccactgtcactctgttcccacct

SEQ ID NO: 561216 - DNA, 484 bp, Homo sapiens
  misc_feature: HIJSMM301BM0AZ.5.39.D06.1.454.light.4.raw
atcagacacgcacgaccggtgctcgatttagtgacatctcgcagttctttggggggagtcagactcagtcaggacacagcatggacatgagggtccccgctcagctcctggggctcctgctgctctggctcccaggtgccgagggtgacatccagctgacccagtctccctccatcgtgtctgcatccgtaggagacagagtcaccatcacctgccgggccagtcagaatattaatagttggttggcctggtatcaccagaggccaggagaggccccaaagctccttatttatgatgcctccactttgattagtggggtcccaccaacgttcagcggcagtggatctgggacagagttcactctcaccatcagcagcctgcagcctgatgatcttggaacttattactgccaacaatataatagttattggacgttcggccaggggaccaaggtcgaaatagagacgaactgtggctgcaccat

SEQ ID NO: 561217 - DNA, 509 bp, Homo sapiens; identical to SEQ ID NO: 539359
  misc_feature: HIJSMM301DLDOC.47.85.H08.1.454.light.4.raw

SEQ ID NO: 561218 - DNA, 477 bp, Homo sapiens
  misc_feature: HIJSMM301DM9QR.43.63.F08.1.454.light.4.raw
tgtgagtagtcacgaccggtgctcgatttagcgatcgtataagggggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccttcgcttgccgggcaagtcaggacattaaaagtgatttaggctggtatcagcagaaaccagggaaagcccctaagctcctgatctatgctgcatccactttacaaagtggagtcccatcaaggttcagcggcagtggatctggcacagatttcactctcaccatcagcagcctgcagcctgaagattctgcaacttattactgtctacacgattacaattaccctcgtacgttcggccaagggaccaaggtggaaatcaaacgaactgtggctgcaccat

SEQ ID NO: 561219 - DNA, 486 bp, Homo sapiens; identical to SEQ ID NO: 535043
  misc_feature: HIJSMM301DDQCH.46.35.D02.1.454.light.4.raw

SEQ ID NO: 561220 - DNA, 497 bp, Homo sapiens
  misc_feature: HIJSMM301B4765.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtctaggtcagcccaaggccaaccc

SEQ ID NO: 561221 - DNA, 454 bp, Homo sapiens; identical to SEQ ID NO: 535005
  misc_feature: HIJSMM301BSU3M.19.86.H09.1.454.light.4.raw

SEQ ID NO: 561222 - DNA, 516 bp, Homo sapiens
  misc_feature: HIJSMM301CH1ID.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctactgactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtgttcggcggagggaccaagctggccgtcctaggtcagcccaaggctgccccctcggtcactctgttccccgaccctcctcgagtagtaca

SEQ ID NO: 561223 - DNA, 502 bp, Homo sapiens
  misc_feature: HIJSMM301DQY9D.15.56.F01.1.454.light.4.raw
tctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaagcccccaaactcatgatttatgaggacaatgagcggccctcaggggtttctaatcgcttctctggctccaagtctgacaacacggcctccctgacaatctctgggctccaggctgaggacgagggtgattattactgctgcgcatatagaagtcccactgttgtactttttcggcggagggaccaagctgaccgtcctaggtcagcccaaggctgccccctcggtcactctgttcccgccctcctcgctacgtaga

SEQ ID NO: 561224 - DNA, 489 bp, Homo sapiens
  misc_feature: HIJSMM301C31QR.12.27.C05.1.454.light.4.raw
atacgacgtacacgaccggtgctcgatttagacgcgatcgaagggtttggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacggccaacatcacctgctctggagataaattggggcataaatatgtctgctggtatcaacagaaggcaggccagtcccctgtggttatcatctatcaagataacaagcggccctcagggatccctgagcgattctctggctccaactctgggaacacagccactctgaccatcagcgggacccaggctatggatgaggctgactattactgtcaggcgagggacagcagtactgcggtattcggcggagggaccaagctgaccgtctaggtcagcccaaggctgccccctcggt

SEQ ID NO: 561225 - DNA, 502 bp, Homo sapiens
  misc_feature: HIJSMM301EIFVF.21.81.H04.1.454.light.4.raw
tcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggctccctgaccatctctgggctccaggctgatgacgaggctgattattactgcaggtcatatacaatcagcaacacttatgtcttcgggactgggaccaagatcaccgtcctaggtcagcccaaggccaacccccactgtca

SEQ ID NO: 561226 - DNA, 495 bp, Homo sapiens; identical to SEQ ID NO: 535964
  misc_feature: HIJSMM301C7Q7P.16.10.A10.1.454.light.4.raw

SEQ ID NO: 561227 - DNA, 441 bp, Homo sapiens; identical to SEQ ID NO: 535074
  misc_feature: HIJSMM301CCBED.11.3.A03.1.454.light.4.raw

SEQ ID NO: 561228 - DNA, 491 bp, Homo sapiens; identical to SEQ ID NO: 535294
  misc_feature: HIJSMM301DE1A4.16.68.G02.1.454.light.4.raw

SEQ ID NO: 561229 - DNA, 476 bp, Homo sapiens
  misc_feature: HIJSMM301B5GWG.52.73.G07.1.454.light.4.raw
cgcagtacgacacgaccggtgctcgatttagctctacgctcagggggatcaggactcctcagttcaccttctcacaatgaggctccctgctcagctcctggggctgctaatgctctgggtctctggatccagtggggagattgtgatgactcagtctccactctccctgcccgtcacccctggagagacggcctccatctcctgcaggtctagtcagagcctcctgcatagtaatggatacaagtatttggattggtatctgcagaagccagggcagtctccacagctcctgatctatttgggttctaatcgggcctccggggtccctgagaggttcagtggcagtggatcaggcacagattttacactaaaaatcagcagagtggaggctgaggatgttggggtttattactgcatgcaagttctacaaaatcctcgcacttttggccaggggaccaagctggagatcaaacgaa

SEQ ID NO: 561230 - DNA, 485 bp, Homo sapiens
  misc_feature: HIJSMM301AR15U.10.1.A01.1.454.light.4.raw
catagtagtgcacgaccggtgctcgatttagacgtctcatcaggggtccaaacagagcttcagcaagcatagtggggaatctgcaccatgccctgggctctgctcctcctgaccctcctcactcactctgcagtgtcagtggtccaggcagggctgactcagccaccctcggtatccaaggacttgagacagacggccacactcacctgcactgggaacaacaacaatgttggccacgacggagtcgtttggctgcagcagcaccagggccaccctcccaagctcctctccgacaggaataacatccggccctcagggatctcagagagattctctgcatccaggtcaggaagcacagcctccctgaccattactggactccaggctgacgacgaagctgattattactgctcagcatgggacaccggcctcagtgcgtgggtttcggcggagggaccaagctgaccgtcctaggtcagaccccg

SEQ ID NO: 561231 - DNA, 447 bp, Homo sapiens
  misc_feature: HIJSMM301A03YT.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttggggtgtttgggtgttcgggcggagggaccaagctgaccgtcctaagtcagcccaaggctgccccctcggtcactctgttcccgcccctcctccgtgtctgat

SEQ ID NO: 561232 - DNA, 444 bp, Homo sapiens; identical to SEQ ID NO: 535192
  misc_feature: HIJSMM301CIY3M.5.9.A09.1.454.light.4.raw

SEQ ID NO: 561233 - DNA, 490 bp, Homo sapiens
  misc_feature: HIJSMM301D1U4L.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgctaacttattactgccaacagtatcatcatcattgtaatttcggtggaggaccaaggtgaggtcaaacgaactgtggctgcaccatctgtcttcatt

SEQ ID NO: 561234 - DNA, 460 bp, Homo sapiens; identical to SEQ ID NO: 536053
  misc_feature: HIJSMM301BC1FJ.22.28.C06.1.454.light.4.raw

SEQ ID NO: 561235 - DNA, 506 bp, Homo sapiens; identical to SEQ ID NO: 548358
  misc_feature: HIJSMM301B2RBF.9.12.B01.1.454.light.4.raw

SEQ ID NO: 561236 - DNA, 498 bp, Homo sapiens
  misc_feature: HIJSMM301BRXV9.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacgggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggccagcagtggtaacattgtgatattcggcggagggaccaaggtgaccgtcctacgtcagcccaaggctgccccctcggtcactctgtt

SEQ ID NO: 561237 - DNA, 504 bp, Homo sapiens
  misc_feature: HIJSMM301EQAZK.10.9.A09.1.454.light.4.raw
catagtagtgcacgaccggtgctcgatttagcgagacgcgcaggggcagagccctggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctcgggaccaaagtggagagtcaaacgaactgtggctgcacca

SEQ ID NO: 561238 - DNA, 518 bp, Homo sapiens
  misc_feature: HIJSMM301BXW0M.48.14.B03.1.454.light.4.raw
agtatacatacacgaccggtgctcgatttagtgtgagtagttccgcggggtgatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaagtaaaaatggaaacatttacttacattggtttcaacagaggccaggccagtctccaaggcgcctgatttatgacgtttttaaacgggagtctggggtcccagacagattcagcggcagtgggtcagacactgacttcacactgagaatcagcagggttgaggctgaggatgttggcacttattactgcatgcaaggctcacactggcctccgtggacgttcggccgaacgggacccgggtacgggaaagtaaaacgaaactagttggcgtgcaccactctgtcttc

SEQ ID NO: 561239 - DNA, 454 bp, Homo sapiens; identical to SEQ ID NO: 535005
  misc_feature: HIJSMM301EV11Q.19.86.H09.1.454.light.4.raw

SEQ ID NO: 561240 - DNA, 509 bp, Homo sapiens; identical to SEQ ID NO: 535670
  misc_feature: HIJSMM301BIJBN.47.23.C01.1.454.light.4.raw

SEQ ID NO: 561241 - DNA, 504 bp, Homo sapiens
  misc_feature: HIJSMM301BQDR3.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccaaaatagaggtcaaacgaactagtggctgcaccatctgtcttcatt

SEQ ID NO: 561242 - DNA, 521 bp, Homo sapiens; identical to SEQ ID NO: 536990
  misc_feature: HIJSMM301CDKS1.27.23.C01.1.454.light.4.raw
  modified_base (517)..(517): a, c, t, g, unknown or other

SEQ ID NO: 561243 - DNA, 463 bp, Homo sapiens; identical to SEQ ID NO: 543051
  misc_feature: HIJSMM301DDGDO.26.78.H01.1.454.light.4.raw

SEQ ID NO: 561244 - DNA, 494 bp, Homo sapiens
  misc_feature: HIJSMM301CEU1I.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcacgtctaggtcagccaagg

SEQ ID NO: 561245 - DNA, 524 bp, Homo sapiens
  misc_feature: HIJSMM301AR90P.8.33.C11.1.454.light.4.raw
  modified_base (205)..(205): a, c, t, g, unknown or other
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatggggacagacttcactctcaccatcatcagcctggagcctgaagatgttgcagtttattactgttcaacatcgtaccgagtggcctccgggggccacctttcggtcccgtcgggaccgaacggtagggtagagtcaaacgaaccgtagttggctgcaccatctgtcttcta

SEQ ID NO: 561246 - DNA, 517 bp, Homo sapiens; identical to SEQ ID NO: 541955
  misc_feature: HIJSMM301BCTBQ.22.30.C08.1.454.light.4.raw

SEQ ID NO: 561247 - DNA, 491 bp, Homo sapiens
  misc_feature: HIJSMM301DPXKW.4.52.E08.1.454.light.4.raw
agcactgtagcacgaccggtgctcgatttagtcgagctctcagagagaaaggggcagagccctggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccgacagggccactggcatcccagccaggttcagtggcagtgggtctgggacagacttcactctcaccatcaccagcctagagcctgaggattttgcagtttattactgtcagcagcgtagcaactggcctctgctcactttcggcggagggaccaaggtggagatcaaacgaactgt

SEQ ID NO: 561248 - DNA, 501 bp, Homo sapiens
  misc_feature: HIJSMM301A9B6C.9.71.G05.1.454.light.4.raw
tgatacgtctcacgaccggtgctcgatttagtgtcgtcgcaagagagagggggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcggagggaccaggctgaccgtcctgagtcagcccaaggctgccccctcggtcactctgttcccgccctcctc

SEQ ID NO: 561249 - DNA, 486 bp, Homo sapiens; identical to SEQ ID NO: 535043
  misc_feature: HIJSMM301CPPA0.46.35.D02.1.454.light.4.raw

SEQ ID NO: 561250 - DNA, 460 bp, Homo sapiens; identical to SEQ ID NO: 536053
  misc_feature: HIJSMM301AGEBW.22.28.C06.1.454.light.4.raw

SEQ ID NO: 561251 - DNA, 549 bp, Homo sapiens
  misc_feature: HIJSMM301AJK4J.5.27.C05.1.454.light.4.raw
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaataggtggattatgattatgtcttcggtaactagggtaccgaacggtacgaccgtccctacggtcgtagccaacggaccgaacccccaacctacgtcactctcgttccctacccctccctcccgtccgttcg

SEQ ID NO: 561252 - DNA, 501 bp, Homo sapiens
  misc_feature: HIJSMM301EW2CE.47.66.F11.1.454.light.4.raw
agctcacgtacacgaccggtgctcgatttagtcacgcgagaagggggaggaactgctcagttaggacccagagggaaccatggaagccccagctcagcttctcttcctcctgctactctggctcccagaaatcgccggagacattctattgacacaggctccagtcaccctgtctttgtctccaggggaaagagccaccctctcctgcagggccagtcaaagcatcggcaacaatttggcctggtatcaacagaaacctggccaggctcccaggctcctcatctacgatgcatccaacagggccactggcgtcccaggcaggttcagaggcggtgggtctgggacagacttcactctcaccattgacggcctagagcctgaagattttgcagtttattactgtcagcagcgtaacaattggccgatcaccttcggccaagggacacgactggagattaaacgaaactgtggctgcaccatctgtcttcatcttcccgccat

SEQ ID NO: 561253 - DNA, 493 bp, Homo sapiens
  misc_feature: HIJSMM301AESXD.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccaggggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtggaggtcaaacgaactgtaggctgcaccatctgtcttcatt

SEQ ID NO: 561254 - DNA, 496 bp, Homo sapiens
  misc_feature: HIJSMM301BN39D.41.18.B07.1.454.light.4.raw
tctatactatcacgaccggtgctcgatttagtcgctgcgtaagggggggagcctagctgtggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcggggggaccaagctgaccgtcctaggtcagccaaggctccg

SEQ ID NO: 561255 - DNA, 463 bp, Homo sapiens; identical to SEQ ID NO: 535062
  misc_feature: HIJSMM301A84VX.11.73.G07.1.454.light.4.raw

SEQ ID NO: 561256 - DNA, 495 bp, Homo sapiens
  misc_feature: HIJSMM301CAXPU.47.78.H01.1.454.light.4.raw
agctcacgtacacgaccggtgctcgatttagtgtgagtagtttgggtttggggtgatcaggactcctcagttcaccttctcacaatgaggctccctgctcagctcctggggctgctaatgctctgggtcccagatccagtggggatgttgtgatgactcagtctccactctccctgtccgtcacccttgcacagccggcctccatctcctgttggtctggtcaaggcctcgaatacagtgatggaaacacctgcttgaattgctttcaccagaggccaggcccatctccaaggcgcctaatttataagctttctaaccgggactctggggtcccagacagattcagcggcagtggcactgatgtcacactgacaatcagcagggtggaggctgaggatggttggggtttgttcctccatgcaaggtacacactggtccttttggccaggggaccaacctggagatcaaatgaactgtggctgcaccatctgtctt

SEQ ID NO: 561257 - DNA, 514 bp, Homo sapiens; identical to SEQ ID NO: 543870
  misc_feature: HIJSMM301BPRXQ.40.12.B01.1.454.light.4.raw

SEQ ID NO: 561258 - DNA, 506 bp, Homo sapiens; identical to SEQ ID NO: 534969
  misc_feature: HIJSMM301DIKTT.18.37.D04.1.454.light.4.raw

SEQ ID NO: 561259 - DNA, 490 bp, Homo sapiens; identical to SEQ ID NO: 544556
  misc_feature: HIJSMM301CMR3U.15.3.A03.1.454.light.4.raw

SEQ ID NO: 561260 - DNA, 504 bp, Homo sapiens
  misc_feature: HIJSMM301C442I.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcacgtcctaggtcagcccaaggccaacccactgtca

SEQ ID NO: 561261 - DNA, 508 bp, Homo sapiens; identical to SEQ ID NO: 553020
  misc_feature: HIJSMM301A36NJ.17.41.D08.1.454.light.4.raw

SEQ ID NO: 561262 - DNA, 504 bp, Homo sapiens; identical to SEQ ID NO: 535128
  misc_feature: HIJSMM301DO7EQ.19.85.H08.1.454.light.4.raw

SEQ ID NO: 561263 - DNA, 505 bp, Homo sapiens
  misc_feature: HIJSMM301B3FJG.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaacgtggatatcaaacgaactgtggctgcaccatctgtt

SEQ ID NO: 561264 - DNA, 512 bp, Homo sapiens
  misc_feature: HIJSMM301BG4VQ.17.28.C06.1.454.light.4.raw
cgtagactagcacgaccggtgctcgatttagagctcacgtattgggtttggggagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggctgccccctggtcattctgttcccacct

SEQ ID NO: 561265 - DNA, 514 bp, Homo sapiens; identical to SEQ ID NO: 541418
  misc_feature: HIJSMM301A2W9T.17.33.C11.1.454.light.4.raw

SEQ ID NO: 561266 - DNA, 487 bp, Homo sapiens
  misc_feature: HIJSMM301DCANH.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatctccccacctttcggccctgggaccaaagtggatatcaaacgaactgtggctgcaccatctgtt

SEQ ID NO: 561267 - DNA, 513 bp, Homo sapiens
  misc_feature: HIJSMM301CUKQA.22.36.D03.1.454.light.4.raw
acatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaaccccccaactcatcatttatggtgtcactcgtcggccctcaggagtctctcatcgcttctcaggctccaagtctggcaacacggcctccctaaccatctctgggctccagtttgaggacgagtctacttattactgcagttcctttaaattaggcgccactctcgtggttttcggcggaggcaccgaagtgaccgtcctcggtcagcccaaggctgccccctcggtcactc

SEQ ID NO: 561268 - DNA, 485 bp, Homo sapiens
  misc_feature: HIJSMM301BSM8R.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgaggattttgcaacttattactgtctacaagattacacttaccctgggacgttcggccgaacggaccgaaggtaggaaatcaaacgaactagtggctgcaccta

SEQ ID NO: 561269 - DNA, 505 bp, Homo sapiens
  misc_feature: HIJSMM301D7L43.19.85.H08.1.454.light.4.raw
tactctcgtgcacgaccggtgctcgatttagtatcactcagtcgcggggctccaaacagagcttcagcaagcatagtgggaatctgcaccatgccctgggctctgctcctcctgaccctcctcactcactctacagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctgggtcagcccaaggctgccccctcggtca

SEQ ID NO: 561270 - DNA, 493 bp, Homo sapiens; identical to SEQ ID NO: 549803
  misc_feature: HIJSMM301ES5EK.13.56.F01.1.454.light.4.raw

SEQ ID NO: 561271 - DNA, 465 bp, Homo sapiens
  misc_feature: HIJSMM301BK3LV.13.4.A04.1.454.light.4.raw
tcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacaggggtcccatcaaggttcagtggaagtggatctgggacagattttacttcaccatcagcagcctgcagcctgaagatattgcaacatattactgtcagcagtatgataatctcccgatcaccttcggccaagggacacgactggagattaaacgaa

SEQ ID NO: 561272 - DNA, 467 bp, Homo sapiens
  misc_feature: HIJSMM301C18OG.13.4.A04.1.454.light.4.raw
tcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacaggggtcccatcaaggttcagtggaagtggatctgggacagattttactttcaccatcagcagcctgcagcctgaagatattgcaacatattactgtcagcagtatgataatctcccgatcacccttcggccaagggacacgactggagattaaacgaa

SEQ ID NO: 561273 - DNA, 507 bp, Homo sapiens
  misc_feature: HIJSMM301BL90C.8.71.G05.1.454.light.4.raw
ctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccagggaaagcccctaaatacctggtctatactgcatccactttgcaaagtggggtcccatcaaggttcagtggcagtggatttgggacagttttcactctcacaatcagcagtctcgaacctgaagattttgcaacttactactgtcaacagacttacaatataccgaggacgttcggtcaagggaccaaaggtggagatcaaacgaaactgtggctgcaccatctgtcttcatcttcccgccat

SEQ ID NO: 561274 - DNA, 517 bp, Homo sapiens
  misc_feature: HIJSMM301CF9B4.43.59.F04.1.454.light.4.raw
tgtgagtagtcacgaccggtgctcgatttagtacacacacttagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaagcccccaaactcttgatttatgatgtcacttatcggccctcaggggtttcttatcgcttctctggctccaagtctggcaacacggcctccctgaccatctctgggctccaggctgaggacgaggctgattattactgcaactcacttacaacgaccgacacttgcgtattcggcggcgggaccaagctgaccgtcctaggtcagcccaaggctgccccctcggtcactctgttccccg

SEQ ID NO: 561275 - DNA, 499 bp, Homo sapiens; identical to SEQ ID NO: 539754
  misc_feature: HIJSMM301AGZFA.11.21.B10.1.454.light.4.raw

SEQ ID NO: 561276 - DNA, 507 bp, Homo sapiens
  misc_feature: HIJSMM301DMK8L.41.44.D11.1.454.light.4.raw
tctatactatcacgaccggtgctcgatttagcgcagtacgaagggggcgggggtaagaggttgtgtccaccatggcctggactcctctcctcctcctgttcctctctcactgcacaggttccctctcgcaggctgtgctgactcagccgtcttccctctctgcatctcctggagcatcagtcagtctcacctgcaccttgcgcagtggcatcgatgttaataggtacacgatatattggtaccagaggaggccagggagtcctccccaatttctcctgagctacaagtcacagtcagatacacaggcggggctctggacgtccccagacgcttctctggattcaaagatgtttcggccaatgcaggctatttttagtcatctcgtggggtcctagtttgtggatgaggctgactactattgcacggtctggtacagcagcgctggtggtcgttcgggcgggagggactgaacttatccgttcctaggtcacgcccaaggctccccgg

SEQ ID NO: 561277 - DNA, 496 bp, Homo sapiens; identical to SEQ ID NO: 542375
  misc_feature: HIJSMM301A5NA2.7.59.F04.1.454.light.4.raw

SEQ ID NO: 561278 - DNA, 493 bp, Homo sapiens; identical to SEQ ID NO: 546762
  misc_feature: HIJSMM301D4LXU.26.12.B01.1.454.light.4.raw

SEQ ID NO: 561279 - DNA, 487 bp, Homo sapiens
  misc_feature: HIJSMM301EDE0C.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccgaaggtggatatcagacgaa

SEQ ID NO: 561280 - DNA, 449 bp, Homo sapiens
  misc_feature: HIJSMM301B9EIA.11.86.H09.1.454.light.4.raw
cgagagataccacgaccggtgctcgatttagtgctatagacttgggtttgggggccgttcctgggcccagtctgtgctgactcagccaccctcagcgtctgggacccccgggcagagggtcatcatctcttgttctggaagcagctctaatatcggaagtaatactgtaaattggtatcaacaactcccaggaacggccccaaactcctcatctatagtaataatcagcggccctcaggggtccctgaccgattctctggctccaagtctggcacctcagcctccctggccatcagtgggctccagtctgatgatgaggctgattattactgtcagtcctttgacattaaactggatgtggtattcggcggagggacccacgtaaccgtcctaggtcagcccaaggctgcccctcggtcactctgttcccaccctcctcgtatctctcg

SEQ ID NO: 561281 - DNA, 482 bp, Homo sapiens
  misc_feature: HIJSMM301C0GCK.13.8.A08.1.454.light.4.raw
tcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggcaagtcagaccattgacaaatatgtaaattggtatcaacagaagccaggtgaagcccctaagctcctgatctatactgcatccactttgtcaggccgggtcccatcaaggttccgtggcagtggatctgggacagatttcactctcaccatcaccagtctgcaacctgaagactgtgcaacttactactgccaacagtcttacggaacctcgtacacttttggccgaggggaccaggctggagatcaaacgaactgtgctgcaccatctgt

SEQ ID NO: 561282 - DNA, 511 bp, Homo sapiens
  misc_feature: HIJSMM301A7034.48.34.D01.1.454.light.4.raw
agtatacatacacgaccggtgctcgatttagatcgtctgtgttgggtttgggggtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctgttcccgccct

SEQ ID NO: 561283 - DNA, 506 bp, Homo sapiens
  misc_feature: HIJSMM301D5X65.8.33.C11.1.454.light.4.raw
ctcgcgtgtccacgaccggtgctcgatttagagtgagctcgttgggtttggggggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccggggccactttcggccctgggaccaaggtggagatcaaacgaactgtggctgcaccatctgtcttcatt

SEQ ID NO: 561284 - DNA, 496 bp, Homo sapiens; identical to SEQ ID NO: 535109
  misc_feature: HIJSMM301DE2EG.16.78.H01.1.454.light.4.raw

SEQ ID NO: 561285 - DNA, 481 bp, Homo sapiens; identical to SEQ ID NO: 536255
  misc_feature: HIJSMM301B085N.10.53.E09.1.454.light.4.raw

SEQ ID NO: 561286 - DNA, 485 bp, Homo sapiens; identical to SEQ ID NO: 535880
  misc_feature: HIJSMM301CJU2F.7.75.G09.1.454.light.4.raw

SEQ ID NO: 561287 - DNA, 494 bp, Homo sapiens; identical to SEQ ID NO: 534992
  misc_feature: HIJSMM301DQJUE.9.1.A01.1.454.light.4.raw

SEQ ID NO: 561288 - DNA, 501 bp, Homo sapiens
  misc_feature: HIJSMM301BUQD5.16.9.A09.1.454.light.4.raw
tgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagcttccctcagtgtccgtgtccccgggacagacagccagcatcacctgctctggagataacctgggaagtaaatttactttctggtatcagcggaagccaggccagtcccctgttttggtcatctataaagataggaatcggccctcagacatccctgagcgattctctggctccagctctggaaacacagccactctgaccatcaccgggacccagactatggatgaagctgactattactgtcaggcgtgggacagcggcactgtggttttcggcggagggaccaagctgaccgtcctcggtcagcccaaggctgccccctcggtcactctgttcccgccct

SEQ ID NO: 561289 - DNA, 492 bp, Homo sapiens
  misc_feature: HIJSMM301EIO7T.9.34.D01.1.454.light.4.raw
tgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccaccctcagtgtctggggccccagggcagagggtcaccatctcgtgcactggaagtagctccaacatcggggcacgttatgatgtacactggtaccaacaacttccaggaacagcccccaaagtcatcatttatgacaacatgaagcggccctcaggggtccctgaccgattctccggctccaagtctggcacatcagcctccctggccatcactgggctccaggctgaggatgaggctgactattactgccagtcgtatgacagtggcctaagtaacatcgtcttcggaactgggaccaaggtcacgtccg

SEQ ID NO: 561290 - DNA, 484 bp, Homo sapiens; identical to SEQ ID NO: 538094
  misc_feature: HIJSMM301A30OQ.3.10.A10.1.454.light.4.raw

SEQ ID NO: 561291 - DNA, 516 bp, Homo sapiens
  misc_feature: HIJSMM301CRUQG.10.28.C06.1.454.light.4.raw
catagtagtgcacgaccggtgctcgatttagagctcacgtattgggtttgggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagcccccaaactgatgatttatgatgtcagtaatcgaccctcaggggtttctgatcgcttctttgcctccaagtctggcaacacggcctccctgaccatctctgggctccagactgaggacgaggctgattattactgcagctcacatacaagcggcagcggttgggtgttcggcgggggaccacactgaccgtcctaggtcagcccaaggctgccccctcggtcactctgttccccg

SEQ ID NO: 561292 - DNA, 518 bp, Homo sapiens
  misc_feature: HIJSMM301AYHY3.22.30.C08.1.454.light.4.raw
  modified_base (507)..(507): a, c, t, g, unknown or other
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggctgccccctcggtcactctgttcccnccctcctcacg

SEQ ID NO: 561293 - DNA, 488 bp, Homo sapiens
  misc_feature: HIJSMM301APKE9.41.57.F02.1.454.light.4.raw
tctatactatcacgaccggtgctcgatttagctcgatatagttgggtttggggtccaaacagagcttcagcaagcatagtgggaatctgcaccatgccctgggctctgctcctcctgaccctcctcactcactctgcagtgtcagtggtccaggcaggactgactcagccaccctcggtgtccaagggcttgagacagaccgccacactcacctgcactgggaacagctacaatgttggcaacgaaggagcagcttggctgcagcagtaccagggccaccctcccaaattgctatcatacaggaagaacaaccgcccctcggggatctccgagagattctctgcatcaacgtcaggaaacatagcctccctgaccattactggactccagcctgaggacgaggctgactattactgctcagcatgggacagcagcctcaatgtttgggtgtttcggcggagggaccaagctgaccgtcctaggtcacg

SEQ ID NO: 561294 - DNA, 454 bp, Homo sapiens; identical to SEQ ID NO: 535005
  misc_feature: HIJSMM301ALWKA.19.86.H09.1.454.light.4.raw

SEQ ID NO: 561295 - DNA, 492 bp, Homo sapiens; identical to SEQ ID NO: 534967
  misc_feature: HIJSMM301BTV7B.47.64.F09.1.454.light.4.raw

SEQ ID NO: 561296 - DNA, 454 bp, Homo sapiens; identical to SEQ ID NO: 534964
  misc_feature: HIJSMM301B014Y.19.86.H09.1.454.light.4.raw

SEQ ID NO: 561297 - DNA, 473 bp, Homo sapiens; identical to SEQ ID NO: 546716
  misc_feature: HIJSMM301DQTOA.52.49.E05.1.454.light.4.raw

SEQ ID NO: 561298 - DNA, 498 bp, Homo sapiens; identical to SEQ ID NO: 536879
  misc_feature: HIJSMM301C4V0T.22.14.B03.1.454.light.4.raw

SEQ ID NO: 561299 - DNA, 500 bp, Homo sapiens
  misc_feature: HIJSMM301CV90M.21.81.H04.1.454.light.4.raw
tcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacgaggctgattattactgcaggtcatatacaatcagcaacacttatgtcttcgggactgggaccaagatcaccgtctaggtcagcccaaggccaacccactgtca

SEQ ID NO: 561300 - DNA, 502 bp, Homo sapiens
  misc_feature: HIJSMM301AJOW0.41.14.B03.1.454.light.4.raw
tctatactatcacgaccggtgctcgatttagtgtgagtagttccgcggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggagggaccaagctgaccgtcctaggtcagcccaaggctgccccctc

SEQ ID NO: 561301 - DNA, 517 bp, Homo sapiens
  misc_feature: HIJSMM301C97C3.51.43.D10.1.454.light.4.raw
cgatcgtatacacgaccggtgctcgatttagactagcagtaaggggagtctgggcctaaggaagcagcactggtggtgcctcagccatggcctggaccgttctcctcctcggcctcctctctcactgcacagtctctgtgacatcctatgtgctgactcagccaccctcggtgtcagtggccccaggacagacggccaggatttcctgtgggggagacaacattggaagtaaaagtgtacactggtaccagcagaggccaggccaggcccctgtgttggtcgtctatgattataacgaccggccctcagggatccctgaccgattctctggctccatctctgggaacacggccactctgaccatcagcagggtcgaagccggggatgaggccgactattactgtcaggtgtgggaaagtagtagtgatcattatgtcttcggaagtgggaccaaggtcaccgtcctaggtcagcccaaggccaaccccactgtcactctgttcccgccctcctctcg

SEQ ID NO: 561302 - DNA, 484 bp, Homo sapiens; identical to SEQ ID NO: 535400
  misc_feature: HIJSMM301A7UQ4.46.26.C04.1.454.light.4.raw

SEQ ID NO: 561303 - DNA, 491 bp, Homo sapiens; identical to SEQ ID NO: 545038
  misc_feature: HIJSMM301DV7WD.22.25.C03.1.454.light.4.raw

SEQ ID NO: 561304 - DNA, 498 bp, Homo sapiens
  misc_feature: HIJSMM301BNM7P.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccc

SEQ ID NO: 561305 - DNA, 501 bp, Homo sapiens; identical to SEQ ID NO: 536818
  misc_feature: HIJSMM301BZCAH.12.82.H05.1.454.light.4.raw

SEQ ID NO: 561306 - DNA, 497 bp, Homo sapiens
  misc_feature: HIJSMM301C6MRD.11.59.F04.1.454.light.4.raw
cgagagataccacgaccggtgctcgatttagtacacacacttagggattggggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagcccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctatcttttctcttcggaactgggaccacggtcaccgtcctaggtcagcccaaggccaacccactgtcactctgttcccaccctcctcgtatctctcg

SEQ ID NO: 561307 - DNA, 486 bp, Homo sapiens; identical to SEQ ID NO: 540314
  misc_feature: HIJSMM301CH9Z8.16.53.E09.1.454.light.4.raw

SEQ ID NO: 561308 - DNA, 500 bp, Homo sapiens
  misc_feature: HIJSMM301D7X8S.18.26.C04.1.454.light.4.raw
tacgagtatgcacgaccggtgctcgatttagtctagcgactttgggtttgggggggtcagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaagcccctaacctcctgatcaagggtccgtccagtttccagagtggggcctcaacaaggttcagcggcagtggatctgggacagatttcactctcaccatcaccagcctgcagcctgaagattttgcaacttactattgtcaacaggctgacaggttcccgctgactttcggcggaggaccaaggtagagatcaaaggaactgtggctgcaccatctgtcttcatcttcccgccta

SEQ ID NO: 561309 - DNA, 474 bp, Homo sapiens
  misc_feature: HIJSMM301DCERR.5.12.B01.1.454.light.4.raw
atcagacacgcacgaccggtgctcgatttagtagtgtagattccgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaacagtgacattggtgcttatgactatgtctcgtggtatcaaaagtatccagacacagcccccaaactcatcctttatgatgtccgtgttcggccctcaggggtttctgttcgcttctctggctccaagtctggcagcacggcctccctgaccatctctgggctccaggctgaggacgaggctgactattattgcagttcatatggtagtatgaagactcttgtgattttcggcggagggaccaagctgaccgt

SEQ ID NO: 561310 - DNA, 505 bp, Homo sapiens; identical to SEQ ID NO: 545042
  misc_feature: HIJSMM301CSNRD.19.78.H01.1.454.light.4.raw

SEQ ID NO: 561311 - DNA, 479 bp, Homo sapiens
  misc_feature: HIJSMM301BKANO.11.11.A11.1.454.light.4.raw
cgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctcctaaactgctcatctcctgggcatctacccgggcacccggagtccctgaccgattcagtggcagcgggtctgggacagacttcactctcaccatcagcaacctgcaggctgaagatgtggcagttttattactgtcagcagtattgtgaagctccgctcactttcggcggagggaccgcggtggagatcagacgaactgtggctgcaccatctgtctt

SEQ ID NO: 561312 - DNA, 487 bp, Homo sapiens
  misc_feature: HIJSMM301AY0DC.3.12.B01.1.454.light.4.raw
agacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggctcccaggctcctcatctatgatgcatccaccagggccaccggtatcccagccaggttcagtggcagtgggtctgggacagagttcactctcaccatcagcagcctgcagtctgaggattttgcagtttattactgtcagcattacaataactggcctcggctcactttcggcggagggaccaaggtggaggatcaaacgaactgtggctgcaccat

SEQ ID NO: 561313 - DNA, 515 bp, Homo sapiens
  misc_feature: HIJSMM301CF5HH.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaacgccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgccccctcggtcactctgttcccccg

SEQ ID NO: 561314 - DNA, 496 bp, Homo sapiens
  misc_feature: HIJSMM301AOD0P.52.35.D02.1.454.light.4.raw
cgcagtacgacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgtcact

SEQ ID NO: 561315 - DNA, 314 bp, Homo sapiens; identical to SEQ ID NO: 558426
  misc_feature: HIJSMM301AJAQ6.10.86.H09.1.454.light.4.raw

SEQ ID NO: 561316 - DNA, 489 bp, Homo sapiens; identical to SEQ ID NO: 535386
  misc_feature: HIJSMM301B5MOS.12.51.E07.1.454.light.4.raw

SEQ ID NO: 561317 - DNA, 486 bp, Homo sapiens; identical to SEQ ID NO: 535043
  misc_feature: HIJSMM301ES3EE.46.35.D02.1.454.light.4.raw

SEQ ID NO: 561318 - DNA, 483 bp, Homo sapiens
  misc_feature: HIJSMM301BNZU7.52.23.C01.1.454.light.4.raw
cgcagtacgacacgaccggtgctcgatttagtacacgtgattagggattgggtgacttcgcaggcgtagactttgtgtttctcctgctgctctggctctcaggtgccagatgtgacatccagatgacccagtctccatcctccctgtctgcatctgtaggagacagagtcaccttcacttgccgggcgagtcaggacattagcaactatttaaattggtatcagcagaaaccagggaaagcccctaaactcctgatctacgatgcatccaatttggagacaggggtcccatcaaggttcactggaagtggatctgggacacattttacttcaccatcagcggcctgcagcctgaagattttgcaacatattactgtcaacaatatgaagatctccccctcactttcggcggagggaccaaggtggagatcagacgaactgtggctgcaccatctgtcttcatcttcccgccatctgatatacg

SEQ ID NO: 561319 - DNA, 501 bp, Homo sapiens
  misc_feature: HIJSMM301DKLDB.19.10.A10.1.454.light.4.raw
tactctcgtgcacgaccggtgctcgatttagcgtcgatctcagggggaagagctgctcagttaggacccagagggaaccatggaaaccccagcgcagcttctcttcctcctgctactctggctcccagatagcaccggagaaattttcttgacgcagtctccaggcaccctgtctttgacccctggggaaagagccaccctctcctgcagggccgataagagtgttgacagcaccttctttgcctggtaccagcagagacctggccaggctcccaggctcctcgtttatggtgcgtccaccagggccactggcatccccgacaggttcagtggcagtgtgtctgggacagacttcactctcaccatcagcagactggagcctgaagattttgcagtgtattactgtcaacgatatgatgagtcacctccgtggtggacatttggccaggggaccaaggttgaagtcaaacgaactgtggctgcaccatctgtcttcattcc

SEQ ID NO: 561320 - DNA, 484 bp, Homo sapiens; identical to SEQ ID NO: 535400
  misc_feature: HIJSMM301D1Y9V.46.26.C04.1.454.light.4.raw

SEQ ID NO: 561321 - DNA, 474 bp, Homo sapiens; identical to SEQ ID NO: 537034
  misc_feature: HIJSMM301BB6A7.5.15.B04.1.454.light.4.raw

SEQ ID NO: 561322 - DNA, 505 bp, Homo sapiens; identical to SEQ ID NO: 535987
  misc_feature: HIJSMM301EJ4XH.18.37.D04.1.454.light.4.raw

SEQ ID NO: 561323 - DNA, 513 bp, Homo sapiens
  misc_feature: HIJSMM301BYBP5.43.19.B08.1.454.light.4.raw
tgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatccggtcttcggcggagggaccaagttgaccgtcctaagtcagcccaaggctgccccctcggtcactctgttcccgccctcctcta

SEQ ID NO: 561324 - DNA, 498 bp, Homo sapiens
  misc_feature: HIJSMM301B1U4O.10.59.F04.1.454.light.4.raw
  modified_base (447)..(447): a, c, t, g, unknown or other
catagtagtgcacgaccggtgctcgatttagtacacacacttagggattggggggggtctcaggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcaccatctcctgcactggaaccagcagtgatgttggtggttatgactttgtctcctggtaccaacagcagccaggcgaagcccccaaattcatgatttatgatgtcagtgcgcggccctcgggggtccctgatcgcttctctggctccagtctggcaacacggcctccctgaccatctctggcctccagcctgaggatgaggctgattattactgttgctcatatgcaggcggtaccgcgttgggngttcggcggtacgggaccaagcttcgaccgtccgtacggtccacggccccg

SEQ ID NO: 561325 - DNA, 516 bp, Homo sapiens
  misc_feature: HIJSMM301COCQ3.15.34.D01.1.454.light.4.raw
tctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtggggcgtggcatttgggtgttcggcggagggaccaaactgaccgtcctaggtcagcccaaggctgccccctcggtcactcctcg

SEQ ID NO: 561326 - DNA, 447 bp, Homo sapiens; identical to SEQ ID NO: 535020
  misc_feature: HIJSMM301A57Z6.18.9.A09.1.454.light.4.raw

SEQ ID NO: 561327 - DNA, 444 bp, Homo sapiens; identical to SEQ ID NO: 539971
  misc_feature: HIJSMM301C2RH4.8.73.G07.1.454.light.4.raw
  modified_base (426)..(426): a, c, t, g, unknown or other

SEQ ID NO: 561328 - DNA, 492 bp, Homo sapiens; identical to SEQ ID NO: 544236
  misc_feature: HIJSMM301BHVZA.12.23.C01.1.454.light.4.raw

SEQ ID NO: 561329 - DNA, 512 bp, Homo sapiens; identical to SEQ ID NO: 537564
  misc_feature: HIJSMM301DQ42H.17.33.C11.1.454.light.4.raw

SEQ ID NO: 561330 - DNA, 490 bp, Homo sapiens; identical to SEQ ID NO: 541141
  misc_feature: HIJSMM301BCMUP.47.38.D05.1.454.light.4.raw

SEQ ID NO: 561331 - DNA, 498 bp, Homo sapiens
  misc_feature: HIJSMM301DNMGZ.43.27.C05.1.454.light.4.raw
tgtgagtagtcacgaccggtgctcgatttagacgcgatcgaagggtttgggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaacccca

SEQ ID NO: 561332 - DNA, 494 bp, Homo sapiens; identical to SEQ ID NO: 542264
  misc_feature: HIJSMM301CGHAM.13.6.A06.1.454.light.4.raw

SEQ ID NO: 561333 - DNA, 474 bp, Homo sapiens
  misc_feature: HIJSMM301EBKH1.21.14.B03.1.454.light.4.raw
tcgtcgctcgcacgaccggtgctcgatttagtgtgagtagttccgcgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgttgcatccagtttgcaaagtggggtcccatcaaggttcagtggcagtggatctgggacagatttcactctcaccatcagcagtctgcaacctgaagattttgcaacttactactgtcaacagagttacagtaccccgtacactttaggccaggggaccaagctggagatcaaacgaactgtggct

SEQ ID NO: 561334 - DNA, 447 bp, Homo sapiens; identical to SEQ ID NO: 535201
  misc_feature: HIJSMM301D0310.18.9.A09.1.454.light.4.raw

SEQ ID NO: 561335 - DNA, 494 bp, Homo sapiens; identical to SEQ ID NO: 534994
  misc_feature: HIJSMM301EZC01.27.78.H01.1.454.light.4.raw

SEQ ID NO: 561336 - DNA, 503 bp, Homo sapiens; identical to SEQ ID NO: 536834
  misc_feature: HIJSMM301EV901.2.35.D02.1.454.light.4.raw

SEQ ID NO: 561337 - DNA, 488 bp, Homo sapiens
  misc_feature: HIJSMM301CQFPT.19.71.G05.1.454.light.4.raw
tactctcgtgcacgaccggtgctcgatttagtgtcgtcgcaagagagagggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacaagatttcactctcaccatcagcagcctgcaggctgaagatgtggcagtttattattgtcaacaatattattatacttcgtggacgttcggccaagggaccaaggtggatatcagacgaa

SEQ ID NO: 561338 - DNA, 495 bp, Homo sapiens
  misc_feature: HIJSMM301EN7RE.27.78.H01.1.454.light.4.raw
  modified_base (453)..(453): a, c, t, g, unknown or other
agcgtcgtctcacgaccggtgctcgatttagtgtgagtagtttgggtttggggatgagcaaaactgacaagtcaaggcaggaagatgttgccatcacaactcattgggtttctgctgctctgggttctagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaacggganacgactggagattaaacgaactgtggctgcaccatctgtctt

SEQ ID NO: 561339 - DNA, 481 bp, Homo sapiens; identical to SEQ ID NO: 535993
  misc_feature: HIJSMM301BV1K1.21.25.C03.1.454.light.4.raw

SEQ ID NO: 561340 - DNA, 487 bp, Homo sapiens
  misc_feature: HIJSMM301BWQGC.12.33.C11.1.454.light.4.raw
atacgacgtacacgaccggtgctcgatttagagtgagctcgttgggtttgggggcaggagtcagtctcagtcaggacacagcatggacatgagggtccccgctcagctcctggggctcctgctactctggctccgaggtgccagatgtgacatccagatgacccagtctccttcctccctgtctgcatctgtcggagacagcgtcaccatcacttgtcgggcaagtcagaacatttacaattatttaaattggtatcagcagaaaccagggaaagcccctaaactcctgatctatcatgaatccagtttgcgaagtggagtcccatcaaggttcagtggcactgggtctgagacagagttcactctcaccatcagcactctacagcctgaagattttgcaacttattattgttcaacaaagttatgagacccctgccactttcggccctgggaccatagtggatatgaaacgaactgtggctgcacc

SEQ ID NO: 561341 - DNA, 496 bp, Homo sapiens; identical to SEQ ID NO: 537513
  misc_feature: HIJSMM301BBR1N.12.87.H10.1.454.light.4.raw

SEQ ID NO: 561342 - DNA, 389 bp, Homo sapiens
  misc_feature: HIJSMM301D1OZC.12.6.A06.1.454.light.4.raw
atacgacgtacacgaccggtgctcgatttagatctactgacagggccagtcagagtcttagtagaggtcagatctttaccagggccagtccgactggtagcagcagcaacctagcctggtaccagcagagacctggccaggctcccaggctcctcatctatggcgcatccaaaagggccactggcatcccagacaggttcagtggctctggctctgggactgacttcactctcatcatcgacagactggagcctgaagattttgcagtctattactgtcaacagtatggtagcccacctaacacttttggcccggggaccaagctggagatcagacgaactgtggctgcaccatctgtcttcatcttcccgccatctgatacgtcgtat

SEQ ID NO: 561343 - DNA, 497 bp, Homo sapiens
  misc_feature: HIJSMM301AMAVH.4.59.F04.1.454.light.4.raw
agcactgtagcacgaccggtgctcgatttagtacacacacttagggattgggggaggaactgctcagttaggacccagacggaaccatggaagccccagcgcagcttctcttcctcctgctactctggctcccagataccactggagaaataatattgacgcagtctccagccaccctgtctgtgtctccaggggaaagagccaccctctcctgcagggccagtcagagtgttagcagcaacttagcctggtaccagcagaagcctggccagactcccaggctcctcatctttggtgcattcaccagggccactgatatcccaaccaggttcagcggcagtgggtctgggacagagttcactctcaccatcagcaacctgcagtctgaagattctgcagtttattattgtcaccagtattatagttggcctccgtggacgttcggccaagggaccaaggtggaaatcaaacgaactagtggctgcaccatctgtctt

SEQ ID NO: 561344 - DNA, 502 bp, Homo sapiens; identical to SEQ ID NO: 557385
  misc_feature: HIJSMM301BTCYH.40.23.C01.1.454.light.4.raw

SEQ ID NO: 561345 - DNA, 518 bp, Homo sapiens; identical to SEQ ID NO: 539372
  misc_feature: HIJSMM301ATRB8.7.86.H09.1.454.light.4.raw

SEQ ID NO: 561346 - DNA, 472 bp, Homo sapiens; identical to SEQ ID NO: 535898
  misc_feature: HIJSMM301A4NUW.15.8.A08.1.454.light.4.raw

SEQ ID NO: 561347 - DNA, 470 bp, Homo sapiens; identical to SEQ ID NO: 536130
  misc_feature: HIJSMM301CIY5M.7.81.H04.1.454.light.4.raw

SEQ ID NO: 561348 - DNA, 511 bp, Homo sapiens
  misc_feature: HIJSMM301CD5UY.43.19.B08.1.454.light.4.raw
  modified_base (502)..(502): a, c, t, g, unknown or other
tgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatccggtcttcggcggagggaccaagttgaccgtcctaagtcagccaaggctgccccctcggtcactctgttcccnccctcctca

SEQ ID NO: 561349 - DNA, 494 bp, Homo sapiens; identical to SEQ ID NO: 534994
  misc_feature: HIJSMM301CWGY9.27.78.H01.1.454.light.4.raw

SEQ ID NO: 561350 - DNA, 489 bp, Homo sapiens
  misc_feature: HIJSMM301CP0L8.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcaccggtcctaggtcagcccaaggcccaaccca

SEQ ID NO: 561351 - DNA, 494 bp, Homo sapiens; identical to SEQ ID NO: 539922
  misc_feature: HIJSMM301AEX2K.27.78.H01.1.454.light.4.raw

SEQ ID NO: 561352 - DNA, 501 bp, Homo sapiens; identical to SEQ ID NO: 535746
  misc_feature: HIJSMM301C87UG.18.11.A11.1.454.light.4.raw

SEQ ID NO: 561353 - DNA, 444 bp, Homo sapiens; identical to SEQ ID NO: 535027
  misc_feature: HIJSMM301DJVQU.8.73.G07.1.454.light.4.raw

SEQ ID NO: 561354 - DNA, 497 bp, Homo sapiens; identical to SEQ ID NO: 536371
  misc_feature: HIJSMM301B8TBI.16.78.H01.1.454.light.4.raw

SEQ ID NO: 561355 - DNA, 482 bp, Homo sapiens; identical to SEQ ID NO: 539800
  misc_feature: HIJSMM301D9ZOM.21.25.C03.1.454.light.4.raw

SEQ ID NO: 561356 - DNA, 493 bp, Homo sapiens
  misc_feature: HIJSMM301BP4B4.40.1.A01.1.454.light.4.raw
tctagcgactcacgaccggtgctcgatttagacgtctcatcagggggcaggagtcagtcccaaccaggacacagcatggacatgagggtccctgctcagctcctggggctcctgctgctctggctctcaggtgccagatgtgacatccagctgacccagtctccatcctccctgtctgcatctgttggagacagagtcaccatcacttgccaggcgagtcaggacattagtaaatatttgaattggtatcaacaaaaaccagggaaagcccctaagctcctgatctacgatgcatctaagttggaaacaggggtctcatcaaggttcagtggaagtggatctgggacagatcctactttcaccatcagcagcctgcagtctgaagattttgcaacttattactgtctacaagattataattaaccctcggacgttcggtccagggaccgaacggtggagtgtcaagacgaactagtggctggcaccacttacg

SEQ ID NO: 561357 - DNA, 493 bp, Homo sapiens
  misc_feature: HIJSMM301BPVWZ.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagcggcctgcagtctgaagattttgctagtttattactgtcagcagtataatgactgggttttattctactttcggccctgggaccaaagtggattcagacgaactgtggctgcaccatctgtcttcta

SEQ ID NO: 561358 - DNA, 447 bp, Homo sapiens; identical to SEQ ID NO: 535020
  misc_feature: HIJSMM301ENSEP.18.9.A09.1.454.light.4.raw

SEQ ID NO: 561359 - DNA, 509 bp, Homo sapiens; identical to SEQ ID NO: 536047
  misc_feature: HIJSMM301D5O9W.17.33.C11.1.454.light.4.raw

SEQ ID NO: 561360 - DNA, 482 bp, Homo sapiens; identical to SEQ ID NO: 535796
  misc_feature: HIJSMM301D4FSE.51.64.F09.1.454.light.4.raw

SEQ ID NO: 561361 - DNA, 505 bp, Homo sapiens
  misc_feature: HIJSMM301ELIGM.5.24.C02.1.454.light.4.raw
atcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagctagccccatgtgatcttcgggcggggggaccaagctgaccgtcctagtcagcccaaggctgcccccc

SEQ ID NO: 561362 - DNA, 461 bp, Homo sapiens
  misc_feature: HIJSMM301CRRLG.52.8.A08.1.454.light.4.raw
cgcagtacgacacgaccggtgctcgatttagcatactctacagggggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctcccgctcactttcggcgggggaccaaggtggagatcaagcgaa

SEQ ID NO: 561363 - DNA, 501 bp, Homo sapiens
  misc_feature: HIJSMM301A55EK.3.71.G05.1.454.light.4.raw
  modified_base (488)..(488): a, c, t, g, unknown or other
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggccagcagtggtaacattgtgatattcggcggagggaccaagggtgaccgtcctacgtcagcccacggacgtgcccccnccggtcactctcg

SEQ ID NO: 561364 - DNA, 504 bp, Homo sapiens
  misc_feature: HIJSMM301EZI5Y.41.37.D04.1.454.light.4.raw
tctatactatcacgaccggtgctcgatttagtagcatactgttgggtttggggctgggcctcaggaagcagcatcggaggtgcctcagccatggcgtggatccctctcttcctcggcgtccttgcttcctgcacagtttccgtggcctcctcggaattgactcaggcaccctcagtgtccgtgtctccaggacagacagccagaatcacctgctctggagacacgttgggggagacatttgcttcctggtatcaacagaggccaggccagtcccctatcctggtcatctttcaggatgacaaacggccctctggcatccctgaacgcttctctggttccaggtcaggaaacagagccactctaaccatcaccgagacccaggctgtcgatgaggctgactattactgtcaggcctgggacagaaacactggcatattcggcggagggaccaagctgaccgtcctacgtcagcccaaggctgccccctcggtcactctgttcccg

SEQ ID NO: 561365 - DNA, 501 bp, Homo sapiens; identical to SEQ ID NO: 536142
  misc_feature: HIJSMM301C9LQD.15.1.A01.1.454.light.4.raw

SEQ ID NO: 561366 - DNA, 484 bp, Homo sapiens; identical to SEQ ID NO: 535400
  misc_feature: HIJSMM301AU1VJ.46.26.C04.1.454.light.4.raw

SEQ ID NO: 561367 - DNA, 496 bp, Homo sapiens; identical to SEQ ID NO: 536326
  misc_feature: HIJSMM301BKDU5.16.12.B01.1.454.light.4.raw

SEQ ID NO: 561368 - DNA, 503 bp, Homo sapiens
  misc_feature: HIJSMM301E1A9T.48.36.D03.1.454.light.4.raw
agtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcggggtccctgatcgcttctctggctccaagtctggcaacacggcctccctgaccatctctgggctccaggctgaagatcaggctgattattactgctgttcattttcaagttcctttttgtcttcggaactgggaccgaggtcaccgtcctaggtcagcccaaggccaaccccactgtcta

SEQ ID NO: 561369 - DNA, 501 bp, Homo sapiens
  misc_feature: HIJSMM301A4QC1.10.50.E06.1.454.light.4.raw
catagtagtgcacgaccggtgctcgatttagatctactgacaacacacaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcataattcatgatgtcaataatcggccctcaggggtttctaatcgcttctctggcttcaagtctggcaacacggcctccctgaccatctctgggctccaggctgaggacgaggctgattattactgcagctcatatacaaccagcagcactcgggtgttcggcggagggaccaagctgaccgtcctaggtcagcccaaggctgcccccc

SEQ ID NO: 561370 - DNA, 502 bp, Homo sapiens
  misc_feature: HIJSMM301ADS54.18.11.A11.1.454.light.4.raw
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagttttattactgtcagcaatactatagtcctcctctcacgttcggcggagggaccaaggtggagatcaaacgaactgtggctgcaccatctgtctt

SEQ ID NO: 561371 - DNA, 501 bp, Homo sapiens; identical to SEQ ID NO: 542622
  misc_feature: HIJSMM301CGPW8.14.57.F02.1.454.light.4.raw

SEQ ID NO: 561372 - DNA, 499 bp, Homo sapiens; identical to SEQ ID NO: 557417
  misc_feature: HIJSMM301D2AH5.12.26.C04.1.454.light.4.raw

SEQ ID NO: 561373 - DNA, 486 bp, Homo sapiens; identical to SEQ ID NO: 535290
  misc_feature: HIJSMM301CNXQ3.3.12.B01.1.454.light.4.raw

SEQ ID NO: 561374 - DNA, 488 bp, Homo sapiens; identical to SEQ ID NO: 535990
  misc_feature: HIJSMM301D7BFE.11.28.C06.1.454.light.4.raw

SEQ ID NO: 561375 - DNA, 521 bp, Homo sapiens
  misc_feature: HIJSMM301AJ3YQ.17.42.D09.1.454.light.4.raw
cgtagactagcacgaccggtgctcgatttagacacatacgcagggaaagggggccccagctctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccaccct

SEQ ID NO: 561376 - DNA, 496 bp, Homo sapiens
  misc_feature: HIJSMM301BXTL9.2.49.E05.1.454.light.4.raw
acgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccgggcagagggtcaccatctcttgttctggaagcatgtccaacatcggaagtgataatgtatactggtaccagcagttcccaagagcggcccccaagctcctcatctatagaaattatgaacggtcctcagggtccctgaccgattctctggctccaagtctggcacctcagcctccctggccatcagtgggctccggtccgaggatgaggctgattattactgtgttggatgggacagcagcctgagtgcttatgtcttcggaactgggaccacggtcaccgtcct

SEQ ID NO: 561377 - DNA, 492 bp, Homo sapiens; identical to SEQ ID NO: 535126
  misc_feature: HIJSMM301CPFI3.18.11.A11.1.454.light.4.raw

SEQ ID NO: 561378 - DNA, 461 bp, Homo sapiens
  misc_feature: HIJSMM301BX36T.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcgaggggtccctgaccgattctctggctctaagtctggcacctcggcctccctggacatcagtggcctccggtccgaggatgaggctgattattactgtgcagcatgggattacaacctgagtgatcctagttgggtgttcggcggagggaccaggctgaccgtcctaggtcagcccaaggctcgccccctcggtcactctgttcccaccctcctcacgctatgt

SEQ ID NO: 561379 - DNA, 491 bp, Homo sapiens; identical to SEQ ID NO: 535176
  misc_feature: HIJSMM301BUY2G.13.39.D06.1.454.light.4.raw

SEQ ID NO: 561380 - DNA, 485 bp, Homo sapiens; identical to SEQ ID NO: 536040
  misc_feature: HIJSMM301BHBFY.15.1.A01.1.454.light.4.raw

SEQ ID NO: 561381 - DNA, 521 bp, Homo sapiens; identical to SEQ ID NO: 549643
  misc_feature: HIJSMM301A92KT.10.86.H09.1.454.light.4.raw

SEQ ID NO: 561382 - DNA, 469 bp, Homo sapiens; identical to SEQ ID NO: 536091
  misc_feature: HIJSMM301CI0OC.3.82.H05.1.454.light.4.raw

SEQ ID NO: 561383 - DNA, 488 bp, Homo sapiens; identical to SEQ ID NO: 541295
  misc_feature: HIJSMM301CWPJF.9.59.F04.1.454.light.4.raw

SEQ ID NO: 561384 - DNA, 507 bp, Homo sapiens; identical to SEQ ID NO: 549050
  misc_feature: HIJSMM301AEU7B.18.37.D04.1.454.light.4.raw

SEQ ID NO: 561385 - DNA, 472 bp, Homo sapiens
  misc_feature: HIJSMM301BET3X.48.5.A05.1.454.light.4.raw
agtatacatacacgaccggtgctcgatttagatagatagacaggggggagtcagacccagtcaggacacagcatggacatgagggtccccgctcagctcctggggctcctgctgctctggctcccaggtgccaaatgtgacatccagatgacccaggctccttccaccctgtctgcatctgtaggagacagagtcaccatcacttgccgggccagtcagagtattgttagctggttggcctggtatcaacagagaccagggaaagcccctaaactcctgatctatacggcatctactttacagagtggggtcccatcaaggttcagcggcagtgcatctgggacagaattcactctcaccatcagcagcctgcagcctgatgattttgcaacttattactgccaacagtattatacttatccatgacgttcgccaaggaccaagtggaaatcaacaactgtggctgcaccat

SEQ ID NO: 561386 - DNA, 469 bp, Homo sapiens
  misc_feature: HIJSMM301A4KRT.51.53.E09.1.454.light.4.raw
cgatcgtatacacgaccggtgctcgatttagagagagtgtgttgggtttgggggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacagggtcccatcaaggttcagtggaagtggctctgggacagattttactttcaccatcagcaggctgcagcctgaagacattgcaacatattactgtcaacagtatgatagtctccgctcactttcggcggggggaccgaaggtggagagtcaagcgaa

SEQ ID NO: 561387 - DNA, 503 bp, Homo sapiens
  misc_feature: HIJSMM301C8DMW.5.59.F04.1.454.light.4.raw
atcagacacgcacgaccggtgctcgatttagtacacacacttagggattggggagaagagctgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctgggacagacttcactctcaccatcagcagactggagcctgaagattttgcagtgtattactgtcagcagtatggtagctcacggacgttcggccaagggaccgaacggtagggaaatacaaacgaactagtggctgcaccatctgtcttcat

SEQ ID NO: 561388 - DNA, 441 bp, Homo sapiens; identical to SEQ ID NO: 535074
  misc_feature: HIJSMM301A6CKC.11.3.A03.1.454.light.4.raw

SEQ ID NO: 561389 - DNA, 495 bp, Homo sapiens; identical to SEQ ID NO: 535007
  misc_feature: HIJSMM301D0HGN.22.5.A05.1.454.light.4.raw

SEQ ID NO: 561390 - DNA, 487 bp, Homo sapiens; identical to SEQ ID NO: 536206
  misc_feature: HIJSMM301CTNPM.47.38.D05.1.454.light.4.raw

SEQ ID NO: 561391 - DNA, 487 bp, Homo sapiens; identical to SEQ ID NO: 555321
  misc_feature: HIJSMM301D3C0A.19.71.G05.1.454.light.4.raw

SEQ ID NO: 561392 - DNA, 484 bp, Homo sapiens; identical to SEQ ID NO: 536393
  misc_feature: HIJSMM301DIUBA.4.41.D08.1.454.light.4.raw

SEQ ID NO: 561393 - DNA, 521 bp, Homo sapiens
  misc_feature: HIJSMM301BZQ01.13.53.E09.1.454.light.4.raw
tcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctccccggacgttcggccgaacgggaccgaacggtacggaaagtactaacgacgaactacgtcggtcgtgcgaccaactctcgttcttctactt

SEQ ID NO: 561394 - DNA, 501 bp, Homo sapiens
  misc_feature: HIJSMM301B6VC8.8.64.F09.1.454.light.4.raw
ctcgcgtgtccacgaccggtgctcgatttagcgcgtatacaaggggcagcactcaggacaatctccagcatggcctggtctcctctcctcctcactctcctcgctcactgcacagggtcctgggcccagtctgagctgacgcagccgccctcagtgtctggggccccagggcagagggtcaccatctcctgcactggggacaactccaacatcggggcaggttataatgtttactggtatcaacaacttccagggacagcccccaaactcctcttgtatggtgacaactatcggccctcaggtgtccctgaccggatctctggctccaagtctggcacctcagcctccctggccatcactgggctccaggctgaagatgaggctgattattactgccagtcttatgacagccgcctgagtggctatgtgcttttcggcgggggaccaagctgaccgtcctacgtcagcccaaggctgccccctcggtcactctgttccccg

SEQ ID NO: 561395 - DNA, 505 bp, Homo sapiens
  misc_feature: HIJSMM301BG74U.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggccgtccgggggccacttcggccctgggaccaaagtggatatcaaacgaactgtggctgcaccatctgtctt

SEQ ID NO: 561396 - DNA, 503 bp, Homo sapiens
  misc_feature: HIJSMM301EIKJS.2.21.B10.1.454.light.4.raw
acgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaggacaggcccctgtaattgtcatctatggaatctatggtaaaaacaaccggccctcagggatcccagaccgattctctggctcctactcaggaaacacagcttccttgaccatcactggggctcaggcggaagatgaggctgactattattgtaagtccgggacagaagtggtaattacatggtgttcggcggagggaccaagctgaccgtcctacgtcagccaaggctgccccctcggtcact

SEQ ID NO: 561397 - DNA, 503 bp, Homo sapiens; identical to SEQ ID NO: 538884
  misc_feature: HIJSMM301D6COD.27.78.H01.1.454.light.4.raw

SEQ ID NO: 561398 - DNA, 502 bp, Homo sapiens; identical to SEQ ID NO: 547421
  misc_feature: HIJSMM301E1B8I.51.5.A05.1.454.light.4.raw

SEQ ID NO: 561399 - DNA, 486 bp, Homo sapiens; identical to SEQ ID NO: 535043
  misc_feature: HIJSMM301AXM31.46.35.D02.1.454.light.4.raw

SEQ ID NO: 561400 - DNA, 493 bp, Homo sapiens; identical to SEQ ID NO: 539702
  misc_feature: HIJSMM301EO2GA.27.78.H01.1.454.light.4.raw

SEQ ID NO: 561401 - DNA, 452 bp, Homo sapiens
  misc_feature: HIJSMM301AVRWB.13.23.C01.1.454.light.4.raw
tcacgtactacacgaccggtgctcgatttagtacacgtgattagggattgggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatctacaacacaaacactcgctcttctggggtccctcatcgcttctctggctccatccttgggaacaaagctgcccttatcatcacgggggcccaggcagaagatgaatctgattattactgtgttctttatatgggtagtgccatttctgctgtgttcggaggaggcacccggctgaccgtcctcggtcagcccaaggctgccccatcggtcactctgttcccaccctcctctagtacgtga

SEQ ID NO: 561402 - DNA, 517 bp, Homo sapiens; identical to SEQ ID NO: 536522
  misc_feature: HIJSMM301ETCT1.8.87.H10.1.454.light.4.raw

SEQ ID NO: 561403 - DNA, 446 bp, Homo sapiens; identical to SEQ ID NO: 536106
  misc_feature: HIJSMM301CPK83.18.9.A09.1.454.light.4.raw

SEQ ID NO: 561404 - DNA, 488 bp, Homo sapiens; identical to SEQ ID NO: 535081
  misc_feature: HIJSMM301CDFB1.26.23.C01.1.454.light.4.raw

SEQ ID NO: 561405 - DNA, 516 bp, Homo sapiens; identical to SEQ ID NO: 543729
  misc_feature: HIJSMM301COVTV.5.27.C05.1.454.light.4.raw

SEQ ID NO: 561406 - DNA, 504 bp, Homo sapiens
  misc_feature: HIJSMM301BG9FL.18.59.F04.1.454.light.4.raw
tacgagtatgcacgaccggtgctcgatttagtacacacacttagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccgggctgaggacgaggctgattattactgcagctcatatacaagcaccagcactctctatgtcttcggaactgggaccaaggtcaccgtcctaggtcagcccaaggccaacccca

SEQ ID NO: 561407 - DNA, 504 bp, Homo sapiens; identical to SEQ ID NO: 538423
  misc_feature: HIJSMM301DNOL9.48.67.G01.1.454.light.4.raw

SEQ ID NO: 561408 - DNA, 488 bp, Homo sapiens; identical to SEQ ID NO: 536742
  misc_feature: HIJSMM301BBW97.3.72.G06.1.454.light.4.raw

SEQ ID NO: 561409 - DNA, 418 bp, Homo sapiens; identical to SEQ ID NO: 536100
  misc_feature: HIJSMM301BZE97.41.53.E09.1.454.light.4.raw

SEQ ID NO: 561410 - DNA, 500 bp, Homo sapiens
  misc_feature: HIJSMM301BBSBZ.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctccaagtctggcaacacggcctccctgaacatctctgggctccaggctgaggatgaggctgattactactgtctgtcctatgacgacgacctacagactccggttttcggcggagggactaagctgaccgtcctaagtcagcccaaggctgccccctc

SEQ ID NO: 561411 - DNA, 506 bp, Homo sapiens; identical to SEQ ID NO: 560391
  misc_feature: HIJSMM301C6WJM.19.85.H08.1.454.light.4.raw

SEQ ID NO: 561412 - DNA, 496 bp, Homo sapiens
  misc_feature: HIJSMM301DCYO7.48.63.F08.1.454.light.4.raw
agtatacatacacgaccggtgctcgatttagcgatcgtataaggggggagtcagacccagtcaggacacagcatggacatgagggtccccgctcagctcctggggctcctgctgctctggctcccaggtgccgagtgtgacatccagatgacccagtttccttccgccctgtctgcatctgtgggagacagagtcaccatcacttgtcgggccagtcagagtgttaataagtggttggcctggtatcagcagaaacccgggaaagcccctaacctcctaatctatgaggcatctactctacaaagtggagtcccatccaggttcagcggcagtgcatctgggaccgacttcagtctcaccatcagcagcctgcaccctgatgattttgcaacttattactgtcaacaatattatacttacccgtacacttttggccaggggactaagctggagatcaaacgaactgtggctgcaccatctgtcttcatcttccccg

SEQ ID NO: 561413 - DNA, 484 bp, Homo sapiens; identical to SEQ ID NO: 535400
  misc_feature: HIJSMM301B9YLP.46.26.C04.1.454.light.4.raw

SEQ ID NO: 561414 - DNA, 480 bp, Homo sapiens
  misc_feature: HIJSMM301BHUAR.43.12.B01.1.454.light.4.raw
tgtgagtagtcacgaccggtgctcgatttagtagtgtagatcccgcggggggagtcagacccagtcaggacacagcatggacatgagggtccccgctcagctcctggggctcctgctgctctggttcccaggttccagatgcgacatccagctgacccagtctccatcttctgtgtctgcatctgtgggagacacagtcaccatcacttgtcgggcgagtcaagttattagtaactggttagcctggtatcagcagaaaccaggaaaagcccctaaactcctgatctatgctgcatccaggttgcagagtggggtcccatcaagattcagcggcagtggatctgggacagatttcactctcactatcagcagcctgcagcctgaagattttgccacttactattgtcaacaggctgacagtttccccttcaccttcggccaagggacacgactggacattaaacgaactgtggctgcacc

SEQ ID NO: 561415 - DNA, 479 bp, Homo sapiens; identical to SEQ ID NO: 542895
  misc_feature: HIJSMM301AV4H0.40.59.F04.1.454.light.4.raw

SEQ ID NO: 561416 - DNA, 475 bp, Homo sapiens
  misc_feature: HIJSMM301CHJJB.3.2.A02.1.454.light.4.raw
agacgcactccacgaccggtgctcgatttagactcatctacagggggtcagtctcagtcaggacacagcatggacatgagggtccccgctcagctcctggggctcctgctactctggctccgaggtgccagatgtgacatccagatgatccagtctccttcctccctgtctgcatctgtgggagacagagtcaccctcacttgccggccaagtcacagcattagcatctatttaaattggtatcaacagaagccagggaaagcccctaacctcctgatctatactgcatccagtttgcaaagtggagtcccatcaaggttcagtggcagtggatctgggacagagttcactctcaccatcagcagtctgcaacctgaagattttgcaacttactactgtcaacagagttacagtatccctccaaccttcggcggagggaccaaggtggagatcaaacgaactgtggctgcaccat

SEQ ID NO: 561417 - DNA, 444 bp, Homo sapiens; identical to SEQ ID NO: 535856
  misc_feature: HIJSMM301E08HL.9.9.A09.1.454.light.4.raw

SEQ ID NO: 561418 - DNA, 516 bp, Homo sapiens
  misc_feature: HIJSMM301EK9R0.5.27.C05.1.454.light.4.raw
  modified_base (506)..(506): a, c, t, g, unknown or other
atcagacacgcacgaccggtgctcgatttagacgcgatcgaagggtttgggagggtttgggaacctatgaacattctgtaggggccactttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgttcccaccctccctccgtntctgactcta

SEQ ID NO: 561419 - DNA, 487 bp, Homo sapiens; identical to SEQ ID NO: 536272
  misc_feature: HIJSMM301ENHB6.17.25.C03.1.454.light.4.raw

SEQ ID NO: 561420 - DNA, 485 bp, Homo sapiens; identical to SEQ ID NO: 543370
  misc_feature: HIJSMM301DYOEP.3.10.A10.1.454.light.4.raw

SEQ ID NO: 561421 - DNA, 503 bp, Homo sapiens
  misc_feature: HIJSMM301C4KZ9.51.59.F04.1.454.light.4.raw
cgatcgtatacacgaccggtgctcgatttagtacacacacttagggattgggggaggaactgctcagttaggacccagagggaaccatggaagccccagctcagcttctcttcctcctgctactctggctcccagataccatcggggaaactgtgttgacacagtctccagccaccctgtctttgtctccaggggaaagagccaccctctcctgcagggccagtgagagtattgacatcttcttggcctggtaccaacagaaacctggccaggctccccgactcctcatttatgatgcatccaaaagggtcgttggcatcccagccaggttcagtggcagtgggtctgggacagaattcactctcaccatcaccagactagagcctgaagattttgcagtttattactgtcagcagcgtaacaactggctctctttcggcggagggaccaaggtggagatcaaacgaactgtggctgcaccatctgtcttcatcttccgccat

SEQ ID NO: 561422 - DNA, 510 bp, Homo sapiens
  misc_feature: HIJSMM301CZYR7.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgtccgaaggaccgaacgtaggaagtacaaacgaactacgtggctgcaccactctgtcttctatcttcctcgact

SEQ ID NO: 561423 - DNA, 523 bp, Homo sapiens
  misc_feature: HIJSMM301C2G4W.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccagggctgaccgtcctaggtcagcccaaggcctgccccctcggtcactctgttcccaccct

SEQ ID NO: 561424 - DNA, 526 bp, Homo sapiens
  misc_feature: HIJSMM301B8319.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcgtccgaacggaccgaacggtaggaaagtaccaaagacgaacgtacgttggcgttcgcgaccaactacctgtcttcctatacttcccgt

SEQ ID NO: 561425 - DNA, 479 bp, Homo sapiens; identical to SEQ ID NO: 540569
  misc_feature: HIJSMM301DIJGS.5.70.G04.1.454.light.4.raw

SEQ ID NO: 561426 - DNA, 472 bp, Homo sapiens; identical to SEQ ID NO: 536302
  misc_feature: HIJSMM301AD2K7.18.76.G10.1.454.light.4.raw

SEQ ID NO: 561427 - DNA, 486 bp, Homo sapiens; identical to SEQ ID NO: 535917
  misc_feature: HIJSMM301EU6SY.3.10.A10.1.454.light.4.raw

SEQ ID NO: 561428 - DNA, 504 bp, Homo sapiens
  misc_feature: HIJSMM301A1EWI.10.9.A09.1.454.light.4.raw
catagtagtgcacgaccggtgctcgatttagcgagacgcgcaggggcagagccctggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggccgtccgggggccaccttcggccctgggaccaaagtaggagatcaaacgaactgtggctgcacca

SEQ ID NO: 561429 - DNA, 522 bp, Homo sapiens; identical to SEQ ID NO: 538091
  misc_feature: HIJSMM301ALFPN.27.23.C01.1.454.light.4.raw

SEQ ID NO: 561430 - DNA, 487 bp, Homo sapiens; identical to SEQ ID NO: 541583
  misc_feature: HIJSMM301BQST2.41.57.F02.1.454.light.4.raw

SEQ ID NO: 561431 - DNA, 507 bp, Homo sapiens
  misc_feature: HIJSMM301E1XCK.10.72.G06.1.454.light.4.raw
catagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggggtttctagtcgcttctctgcctccaagtctggcaacacggcctccctgacaatctctgggctccaggctgacgacgaggctgaatattactgcagctcatatgtagatggtgcctcttttcaaggttttcggcggagggaccaggctgaccgtcctaagtcagcccaaggctgccccctcggt

SEQ ID NO: 561432 - DNA, 507 bp, Homo sapiens; identical to SEQ ID NO: 557429
  misc_feature: HIJSMM301DNIJF.15.59.F04.1.454.light.4.raw

SEQ ID NO: 561433 - DNA, 502 bp, Homo sapiens; identical to SEQ ID NO: 541971
  misc_feature: HIJSMM301A3MD0.4.39.D06.1.454.light.4.raw

SEQ ID NO: 561434 - DNA, 488 bp, Homo sapiens
  misc_feature: HIJSMM301AMY2Q.43.29.C07.1.454.light.4.raw
tgtgagtagtcacgaccggtgctcgatttagagtgctacgaagggaaagggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccccaggcggagggaccaaggtggagatcaaacgaactgtggctgcacc

SEQ ID NO: 561435 - DNA, 479 bp, Homo sapiens; identical to SEQ ID NO: 535586
  misc_feature: HIJSMM301AY9BR.13.34.D01.1.454.light.4.raw

SEQ ID NO: 561436 - DNA, 491 bp, Homo sapiens
  misc_feature: HIJSMM301DMQZW.26.12.B01.1.454.light.4.raw
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtatcccggccagattcagtggcgagggggtctgggacagaattcactctcaccatcaccagcctgcagtctgaagattttgctagtttattactgtcagcagtatcatgactggccgctcaccttcgccaagggacacgactggagattaaacgaactgtgctgcacc

SEQ ID NO: 561437 - DNA, 481 bp, Homo sapiens; identical to SEQ ID NO: 535993
  misc_feature: HIJSMM301E3UX5.21.25.C03.1.454.light.4.raw

SEQ ID NO: 561438 - DNA, 483 bp, Homo sapiens; identical to SEQ ID NO: 550668
  misc_feature: HIJSMM301CVMCV.4.74.G08.1.454.light.4.raw

SEQ ID NO: 561439 - DNA, 496 bp, Homo sapiens; identical to SEQ ID NO: 536802
  misc_feature: HIJSMM301DFFNX.5.24.C02.1.454.light.4.raw

SEQ ID NO: 561440 - DNA, 521 bp, Homo sapiens
  misc_feature: HIJSMM301AV74U.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaaggaccgaagtggcaatacaaccgaactagtggcgtgcaccatctgtcttctatcttccccg

SEQ ID NO: 561441 - DNA, 517 bp, Homo sapiens
  misc_feature: HIJSMM301AUN8I.48.17.B06.1.454.light.4.raw
agtatacatacacgaccggtgctcgatttagtcgatagtgaagggggctggggtcacaagaggcagcgctctcgggacgtctccaccatggcctgggctctgctgctcctcaccctcctcactcaggacacagggtcctgggcccaggctgccctgactcagccagcctccgtgtctgcctctcctggacagtcggtcaatctttcctgcactggaaccgcctatgacattggaaaatataaccttgtctcctggtaccagcaacacccaggcaaagcccccaaattaattatttatacggtcaataagagaccgtcaggggtctctgctcgcttctctgggtccaagtctggcgacacggcctccctcacaatctctgggctccaggctgacgacgaggcttcctattgctgctcctcatatgtaggatccggctcttatctgattttcggcggagggaccaagctgaccgtcctacgtcagcccaaggctgccccctcggtcactctgttccccg

SEQ ID NO: 561442 - DNA, 519 bp, Homo sapiens
  misc_feature: HIJSMM301BJVL7.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctccccccggacgttcggtccaacggaccgaacggtacggaaagtacaagacgaacgtagtggcgtggcaccaactctgtcttctactcttcccgt

SEQ ID NO: 561443 - DNA, 512 bp, Homo sapiens; identical to SEQ ID NO: 542831
  misc_feature: HIJSMM301DKN8F.43.19.B08.1.454.light.4.raw

SEQ ID NO: 561444 - DNA, 487 bp, Homo sapiens; identical to SEQ ID NO: 536206
  misc_feature: HIJSMM301AILNB.47.38.D05.1.454.light.4.raw

SEQ ID NO: 561445 - DNA, 489 bp, Homo sapiens; identical to SEQ ID NO: 535091
  misc_feature: HIJSMM301BNCSY.47.36.D03.1.454.light.4.raw

SEQ ID NO: 561446 - DNA, 494 bp, Homo sapiens; identical to SEQ ID NO: 539894
  misc_feature: HIJSMM301BIOQR.16.53.E09.1.454.light.4.raw

SEQ ID NO: 561447 - DNA, 493 bp, Homo sapiens
  misc_feature: HIJSMM301C5DV5.26.12.B01.1.454.light.4.raw
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtatcccggccagattcagtggcagggggtctgggacagaattcactctcaccatcaccagcctgcagtctgaagattttgcagtctattactgtcagcaatataattactgctctctttcggcgggggaccaagctggagatcaaccgaactgtggctgcaccatctgtt

SEQ ID NO: 561448 - DNA, 479 bp, Homo sapiens; identical to SEQ ID NO: 535118
  misc_feature: HIJSMM301A5Z8T.13.59.F04.1.454.light.4.raw

SEQ ID NO: 561449 - DNA, 487 bp, Homo sapiens; identical to SEQ ID NO: 537573
  misc_feature: HIJSMM301D5R81.3.10.A10.1.454.light.4.raw

SEQ ID NO: 561450 - DNA, 467 bp, Homo sapiens
  misc_feature: HIJSMM301A71FQ.5.36.D03.1.454.light.4.raw
  modified_base (414)..(414): a, c, t, g, unknown or other
atcagacacgcacgaccggtgctcgatttagctgcgtcacgatctctcttgggggagtcagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtggggtcccaccaacgttcagcggcagtggatctgggacagagttcactctcaccatcagcagcctgcagcctgacgatgtggcaacttattactgccaacngtatgatagttattggacgttcggccaagggaccaagatagaaatcaaacgaa

SEQ ID NO: 561451 - DNA, 469 bp, Homo sapiens; identical to SEQ ID NO: 555674
  misc_feature: HIJSMM301ATH6Z.3.68.G02.1.454.light.4.raw

SEQ ID NO: 561452 - DNA, 493 bp, Homo sapiens; identical to SEQ ID NO: 544773
  misc_feature: HIJSMM301B8S1X.21.47.E03.1.454.light.4.raw

SEQ ID NO: 561453 - DNA, 497 bp, Homo sapiens; identical to SEQ ID NO: 535664
  misc_feature: HIJSMM301DWFXW.22.14.B03.1.454.light.4.raw

SEQ ID NO: 561454 - DNA, 492 bp, Homo sapiens; identical to SEQ ID NO: 539815
  misc_feature: HIJSMM301AMNAN.51.81.H04.1.454.light.4.raw

SEQ ID NO: 561455 - DNA, 480 bp, Homo sapiens; identical to SEQ ID NO: 535291
  misc_feature: HIJSMM301BRPGA.22.59.F04.1.454.light.4.raw

SEQ ID NO: 561456 - DNA, 499 bp, Homo sapiens
  misc_feature: HIJSMM301DOKY6.11.75.G09.1.454.light.4.raw
cgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccggttatggtatgctctggtatcaacaacgtccaggaatggcccccaaactcctcatctatgctgacaacaatcgaccttcagggtccctgaccggttctctggctccaagtctggctcttccgcctccttggccatcactgggctcgaggctgacgatgaggctgattactactgtctgtcctatgacgacgacctacagactccggttttcggcggagggactaagctgaccgtcctaagtcagcccaac

SEQ ID NO: 561457 - DNA, 514 bp, Homo sapiens; identical to SEQ ID NO: 556616
  misc_feature: HIJSMM301EMCG3.16.66.F11.1.454.light.4.raw

SEQ ID NO: 561458 - DNA, 484 bp, Homo sapiens; identical to SEQ ID NO: 537878
  misc_feature: HIJSMM301EO6FZ.17.34.D01.1.454.light.4.raw

SEQ ID NO: 561459 - DNA, 502 bp, Homo sapiens; identical to SEQ ID NO: 538897
  misc_feature: HIJSMM301DPRKO.21.38.D05.1.454.light.4.raw

SEQ ID NO: 561460 - DNA, 447 bp, Homo sapiens; identical to SEQ ID NO: 535201
  misc_feature: HIJSMM301DPQ40.18.9.A09.1.454.light.4.raw

SEQ ID NO: 561461 - DNA, 495 bp, Homo sapiens; identical to SEQ ID NO: 536359
  misc_feature: HIJSMM301BCDB6.48.4.A04.1.454.light.4.raw

SEQ ID NO: 561462 - DNA, 484 bp, Homo sapiens; identical to SEQ ID NO: 535441
  misc_feature: HIJSMM301EPX1U.26.60.F05.1.454.light.4.raw

SEQ ID NO: 561463 - DNA, 489 bp, Homo sapiens; identical to SEQ ID NO: 535139
  misc_feature: HIJSMM301AIRVL.14.55.E11.1.454.light.4.raw

SEQ ID NO: 561464 - DNA, 520 bp, Homo sapiens; identical to SEQ ID NO: 535773
  misc_feature: HIJSMM301ATU77.41.19.B08.1.454.light.4.raw

SEQ ID NO: 561465 - DNA, 502 bp, Homo sapiens; identical to SEQ ID NO: 539314
  misc_feature: HIJSMM301DGP0I.21.81.H04.1.454.light.4.raw

SEQ ID NO: 561466 - DNA, 486 bp, Homo sapiens; identical to SEQ ID NO: 536261
  misc_feature: HIJSMM301AR74W.26.55.E11.1.454.light.4.raw

SEQ ID NO: 561467 - DNA, 493 bp, Homo sapiens; identical to SEQ ID NO: 544335
  misc_feature: HIJSMM301D7K5M.5.57.F02.1.454.light.4.raw

SEQ ID NO: 561468 - DNA, 441 bp, Homo sapiens; identical to SEQ ID NO: 546257
  misc_feature: HIJSMM301DR8NF.41.9.A09.1.454.light.4.raw

SEQ ID NO: 561469 - DNA, 477 bp, Homo sapiens
  misc_feature: HIJSMM301C3S9I.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtgttttggctgttcgcggcggac

SEQ ID NO: 561470 - DNA, 491 bp, Homo sapiens; identical to SEQ ID NO: 541127
  misc_feature: HIJSMM301EFE1B.13.11.A11.1.454.light.4.raw

SEQ ID NO: 561471 - DNA, 506 bp, Homo sapiens; identical to SEQ ID NO: 539721
  misc_feature: HIJSMM301B4LZT.3.79.H02.1.454.light.4.raw

SEQ ID NO: 561472 - DNA, 507 bp, Homo sapiens; identical to SEQ ID NO: 538702
  misc_feature: HIJSMM301DQ2AD.11.57.F02.1.454.light.4.raw

SEQ ID NO: 561473 - DNA, 504 bp, Homo sapiens
  misc_feature: HIJSMM301EFS73.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctcgccccctcggtcactcc

SEQ ID NO: 561474 - DNA, 504 bp, Homo sapiens
  misc_feature: HIJSMM301EKK31.48.83.H06.1.454.light.4.raw
agtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcagggggacccaggccttggatgaggctgactatcactgtcaggcgtgggacagcaacactgcgattttcgggcgggggaccaggctgaccgtcggcggtcacgcccaaggctcgccccctcggtcacctctcgttccca

SEQ ID NO: 561475 - DNA, 477 bp, Homo sapiens
  misc_feature: HIJSMM301BIGX3.40.59.F04.1.454.light.4.raw
tctagcgactcacgaccggtgctcgatttagtacacacacttagggattggggtgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggtttcggcggagggaccaagctgaccgtcctaagtcagcccaa

SEQ ID NO: 561476 - DNA, 481 bp, Homo sapiens; identical to SEQ ID NO: 535993
  misc_feature: HIJSMM301CIQCM.21.25.C03.1.454.light.4.raw

SEQ ID NO: 561477 - DNA, 483 bp, Homo sapiens; identical to SEQ ID NO: 535413
  misc_feature: HIJSMM301B21BF.26.78.H01.1.454.light.4.raw

SEQ ID NO: 561478 - DNA, 483 bp, Homo sapiens; identical to SEQ ID NO: 545669
  misc_feature: HIJSMM301AJ56B.13.8.A08.1.454.light.4.raw

SEQ ID NO: 561479 - DNA, 447 bp, Homo sapiens; identical to SEQ ID NO: 535201
  misc_feature: HIJSMM301CU1CT.18.9.A09.1.454.light.4.raw

SEQ ID NO: 561480 - DNA, 479 bp, Homo sapiens; identical to SEQ ID NO: 540947
  misc_feature: HIJSMM301BXSBA.52.1.A01.1.454.light.4.raw

SEQ ID NO: 561481 - DNA, 490 bp, Homo sapiens; identical to SEQ ID NO: 535420
  misc_feature: HIJSMM301C0JUP.3.72.G06.1.454.light.4.raw

SEQ ID NO: 561482 - DNA, 504 bp, Homo sapiens; identical to SEQ ID NO: 535077
  misc_feature: HIJSMM301DW53E.8.28.C06.1.454.light.4.raw

SEQ ID NO: 561483 - DNA, 503 bp, Homo sapiens
  misc_feature: HIJSMM301B0VZM.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctctcaaactcctgtcgtacaggaatgacaaccggccctcaaacatttcagagagattttcacctccaggacacaaaatacagcctctctgaccattactggtctccagcctgacgacgaggctgactactactgctcagcctgggacaccagcctcgctgcttggcttttcggcggagggaccaagctgaccgtcctgggtcagcccaaggctcgccccctccggt

SEQ ID NO: 561484 - DNA, 513 bp, Homo sapiens
  misc_feature: HIJSMM301AVJ45.16.85.H08.1.454.light.4.raw
tgtactactccacgaccggtgctcgatttagtatcactcagtcgcggggctgggcctaaggaagcagcactggtggtgcctcagccatggcctggaccgttctcctcctcggcctcctctctcactgcacaggctctgtgacctcctatgtgctgactcagccaccctcggtgtcgttggccccaggacagacggccttaataacctgtggggaagcaacattggaagcaaaaatgtgcactggtacatgcagaggccaggccaggcccctgtttggtcgtctatgatgataccgagcggccctcagggatccctgagcgattctccggctccaactctggtgacacggccaccctgaccatcaacagggtcgaagtcggggatgaggccgactattactgtcaggtgtgggatggtgttagtgatcgggcacttttcggcggagggacccagctgaccgtcctaggtcagcccaaggctgccccctcggtcactctgttcccgccctcctcg

SEQ ID NO: 561485 - DNA, 507 bp, Homo sapiens
  misc_feature: HIJSMM301CPC4I.9.31.C09.1.454.light.4.raw
tgatacgtctcacgaccggtgctcgatttagacgtctcatcaaggaaggaaggggggggtcgtcaggaggcagcgctctcgggacgtctccaccatggcctgggctctgctattcctcaccctcctcactcagggcacagggtcttgggcccagtctgccctgactcagcctgcctccgtgtctgggtctcctggacagtcgatagccatctcctgcactggaactaacagtgacgttggtgcttataattatgtctcctggtatcaacaacacccaggcaaagccccccaactcattatttctgatgtcaacaatcggcccccagggatttctgatcgcttctctggctccaagtctggcaacacggcctccctgaccatctctgggctccgggctgaggacgaggctcactattactgcagctcatatacaaccagcgacactctgttggttcgcggagggactgaactgaccgtcctaggtcagcccaaggctgccccctcggt

SEQ ID NO: 561486 - DNA, 486 bp, Homo sapiens
  misc_feature: HIJSMM301B5V3S.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctcgccccctcggtcactctgttcccaccctcctcgctacgtaga

SEQ ID NO: 561487 - DNA, 522 bp, Homo sapiens; identical to SEQ ID NO: 543470
  misc_feature: HIJSMM301D749T.5.27.C05.1.454.light.4.raw

SEQ ID NO: 561488 - DNA, 513 bp, Homo sapiens; identical to SEQ ID NO: 535244
  misc_feature: HIJSMM301EA1EO.17.33.C11.1.454.light.4.raw

SEQ ID NO: 561489 - DNA, 506 bp, Homo sapiens; identical to SEQ ID NO: 542696
  misc_feature: HIJSMM301ANH63.7.71.G05.1.454.light.4.raw

SEQ ID NO: 561490 - DNA, 524 bp, Homo sapiens
  misc_feature: HIJSMM301BH6XZ.53.77.G11.1.454.light.4.raw
cgcgtatacacacgaccggtgctcgatttagctagtcactcaagggaaaggggctgggcctaaggaagcagcactggtggtgcctcagccatggcctggaccgttctcctcctcggcctcctctctcactgcacaggctctgtgacctcctttgtgctgactcagtcaccctcggtgtcggtggccccaggacagacggccaggattacctgtgggggaaacaacattggaaggaaaagtgtgcactggtaccagcagatgccaggccaggcccctgtgttggtcgtctatgatgatagcgaccggccctcaggggtccctgagcgattctctggctccaactctgggaacacggccaccctgaccataagcagggtcgaagccggggatgaggccgactattactgtcaggtgtgggatactagtagtgatcatccttgggtgttcggcggtgggaccaggctgaccgtcctaggtcagcccaaggctgccccctcggtcactctgttcccaccctcctctcg

SEQ ID NO: 561491 - DNA, 488 bp, Homo sapiens; identical to SEQ ID NO: 543022
  misc_feature: HIJSMM301DPP0P.9.59.F04.1.454.light.4.raw

SEQ ID NO: 561492 - DNA, 520 bp, Homo sapiens
  misc_feature: HIJSMM301DVGYL.41.53.E09.1.454.light.4.raw
tctatactatcacgaccggtgctcgatttagagagagtgtgttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtaacgttggcggttataactatgtctcctggtaccaacaacacccaggcaaagtccccaaactcataatttatgaggtctctaagcggccctcaggggtccctggtcgcttctctggctccaagtttggcaacacggcctccctgaccgtctctgggctccagagtgaagatgaggctgattactactgcgcctcatatgcaggcagcaacaatttcagggtatttggcggagggaccaagctgaccgtcctgggtcagcccaaggctgccccctcggtcactctgttcccg

SEQ ID NO: 561493 - DNA, 523 bp, Homo sapiens
  misc_feature: HIJSMM301AYR6J.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccgaggctggaccgtcctaggtcagcccaaggctgccccctcggtcactctgttcccaccct

SEQ ID NO: 561494 - DNA, 479 bp, Homo sapiens; identical to SEQ ID NO: 535188
  misc_feature: HIJSMM301DI2BN.10.74.G08.1.454.light.4.raw

SEQ ID NO: 561495 - DNA, 493 bp, Homo sapiens; identical to SEQ ID NO: 535047
  misc_feature: HIJSMM301DPWTB.16.53.E09.1.454.light.4.raw

SEQ ID NO: 561496 - DNA, 486 bp, Homo sapiens
  misc_feature: HIJSMM301BA0FW.48.73.G07.1.454.light.4.raw
agtatacatacacgaccggtgctcgatttagctctacgctcagggcacgaccggtgctcgatttagtagtgtagattcgcgggggctgctcagttaggacccagagggaaccatggaaaccccagcgcagcttctcttcctcctgctactctggctcccagatactaccggagaagttctgttgacgcagtctccaggcaccctgtctttgtctccaggggaaagagccaccctctcctgcagggccagtcagactgttatcagcagctccttagcctggtaccagcagaaacctggccaggctcccaggctcctcatctatggtgcatccagcagggccgctggcatcccagacaggtttagtggcaggtgggtcgtgggacagacttcactctcaccatcagcagactggagcctgaagatttgcagtgtatttctgtcagcagtatggtggctcacccgcgtacagtttggcgagggaccaag

SEQ ID NO: 561497 - DNA, 514 bp, Homo sapiens; identical to SEQ ID NO: 541418
  misc_feature: HIJSMM301EVNRY.17.33.C11.1.454.light.4.raw

SEQ ID NO: 561498 - DNA, 490 bp, Homo sapiens
  misc_feature: HIJSMM301EIUOX.41.67.G01.1.454.light.4.raw
tctatactatcacgaccggtgctcgatttagagtatacatattgggtttggggagagctctggggagtctgcaccatggcttggaccccactcctcttcctcaccctcctcctccactgcacagggtctctctcccagcttgtgctgactcaatcgccctctgcctctgcctccctgggaacctcggtcaagctcacctgcactctgagcagtggagacagcagacacgccatcgcatggcatcagcagcagccaggaaggggccctcgattcctgatgaaacttacttttgatggcagccacaccaagggggacggatccctgatcgcttctcaggctccagctctggggctgagcgctacctttcgatctccagcctccagtctgaggatgaggctgactattactgtcagtcctgggacaggggcgttttggtgttcggcggagggaccagactgaccgtcctgggtcagcccaaggctgccccctc

SEQ ID NO: 561499 - DNA, 508 bp, Homo sapiens; identical to SEQ ID NO: 540739
  misc_feature: HIJSMM301EORDH.14.7.A07.1.454.light.4.raw

SEQ ID NO: 561500 - DNA, 515 bp, Homo sapiens
  misc_feature: HIJSMM301C79H5.8.87.H10.1.454.light.4.raw
ctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagtgtcagtggccctgggacagacggccagaattacctgtggaggagtcaacattgggacttcagatgtgcactggtaccagcagaagccaggccaggcccctgtactggtcatctttagcgattccaaccggccctctgggatccctgagcgattctctggctccaagtcggggaacacggccaccctgaccatcagcagggcccaacccttggatgagggtgactatttctgtcaagtgtgggacaccaacacttgtgtcttcgggactgggaccgaggtcaccgtcctaagtcagcccagggccaaccccactgtcactctgttcccaccctccgacac

SEQ ID NO: 561501 - DNA, 496 bp, Homo sapiens
  misc_feature: HIJSMM301ERDJR.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtggcagtggatctgggacacatttccaccctcaccatcaatagcctggaagctgaagatgctgcaacttattactgtcatcagagtactactttacctcaagtgatcaccttcggccaagggacacgactggagattaaacgaactgtggctgcaccatctgtctt

SEQ ID NO: 561502 - DNA, 454 bp, Homo sapiens; identical to SEQ ID NO: 536846
  misc_feature: HIJSMM301CFB4L.18.78.H01.1.454.light.4.raw

SEQ ID NO: 561503 - DNA, 479 bp, Homo sapiens; identical to SEQ ID NO: 535118
  misc_feature: HIJSMM301BTH41.13.59.F04.1.454.light.4.raw

SEQ ID NO: 561504 - DNA, 468 bp, Homo sapiens
  misc_feature: HIJSMM301BIMXO.7.81.H04.1.454.light.4.raw
  modified_base (458)..(458): a, c, t, g, unknown or other
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcactttcgcctcggactgaagtgcatatgaanagaactgtgg

SEQ ID NO: 561505 - DNA, 416 bp, Homo sapiens; identical to SEQ ID NO: 536892
  misc_feature: HIJSMM301BUIYX.16.46.E02.1.454.light.4.raw

SEQ ID NO: 561506 - DNA, 486 bp, Homo sapiens
  misc_feature: HIJSMM301BNWOE.4.57.F02.1.454.light.4.raw
agcactgtagcacgaccggtgctcgatttagctcgatatagttgggtttggggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtggggtcccatcaagattcagtggcagtggatctgggacagatttcactctcaccatcagtagtctacaacctgaagattttgcaacttactactgtcaacagagttacgatacccctccgctcactttcggcggagggaccaaggtggagatcaaacgaactgtggctgcacc

SEQ ID NO: 561507 - DNA, 465 bp, Homo sapiens
  misc_feature: HIJSMM301ASFV6.12.39.D06.1.454.light.4.raw
atacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatgagggaggggaatggggtgagaaagatccagtgtagagattgtgatgacccagactccagtctccttgtctctcacccctgtagagcaggcctccatgtcctgcaggtctagtctgcgcctcctgcatagtgacggatgctcccttttgtattggtttctgcagagaggcaggccagtctccacaactcctgatctatgaagttgccacccggctctctggagtgccagatatgttcagtggctgcgggtcaggcacagatctcacactgaaaaacagccgggtggagagtgaccatgttggaacttatta

SEQ ID NO: 561508 - DNA, 479 bp, Homo sapiens
  misc_feature: HIJSMM301DCULF.3.1.A01.1.454.light.4.raw
agacgcactccacgaccggtgctcgatttagacgtctcatcaggggagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtggggtcccaccaacgttcagcggcagtggatctgggacagagttcaactctcaccatcagcagcctgcagcctgacgatgtggcaacttattaactgccaaacagtaatgatagttattggacttcggccaagggaccaagatagaaatcaaacgaactgtggctgcaccatctgtctt

SEQ ID NO: 561509 - DNA, 479 bp, Homo sapiens
  misc_feature: HIJSMM301CUOWA.13.48.E04.1.454.light.4.raw
  modified_base (475)..(475): a, c, t, g, unknown or other
tcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaagtggggtcccatcaaggttcagcggcagtggatctggcacagacttcattctcaccatcagcagcctgcagcctgaagattttgcaacttattactgtctacaagatcacaattatcctgggacgttcggccaagggaccaaggtggaaatacaaacgaacngtgg

SEQ ID NO: 561510 - DNA, 497 bp, Homo sapiens
  misc_feature: HIJSMM301C056V.40.11.A11.1.454.light.4.raw
tctagcgactcacgaccggtgctcgatttagctacgactgcagggaggggcagcaagatggtgttgcagacccaggtcttcatttttctgttgctctggatctctggtgcctacggggacatcgtgatgacccagtctccagactccctggctgtgtctctgggcgagagggccaccatcaactgcaagtccagccagagtcttttatacaactccgaacaagcagcactacttagcttggtaccagcagaaaccaggacagcctcctaaactgctcatttactgggcctctacccgggaatccggggtccctgaccgattcagtggcagcgggtctgggacagatttcactctgaccatcagcagcctgcaggctgaagatgtggcagtttattactgtcaacaatattatattattccgaggacgttcggccaagggaccaaggtggaaatcaaacgaactgtggctgcaccatctgtcttcatcttcccgccat

SEQ ID NO: 561511 - DNA, 455 bp, Homo sapiens; identical to SEQ ID NO: 555402
  misc_feature: HIJSMM301AZKW9.5.86.H09.1.454.light.4.raw

SEQ ID NO: 561512 - DNA, 492 bp, Homo sapiens; identical to SEQ ID NO: 540094
  misc_feature: HIJSMM301BTCXH.9.34.D01.1.454.light.4.raw

SEQ ID NO: 561513 - DNA, 510 bp, Homo sapiens
  misc_feature: HIJSMM301EBAMH.17.28.C06.1.454.light.4.raw
cgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatccggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggctgccccctc

SEQ ID NO: 561514 - DNA, 488 bp, Homo sapiens
  misc_feature: HIJSMM301DWIAC.52.85.H08.1.454.light.4.raw
cgcagtacgacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgacctgactcagccaccctcagtgtccgtgtctccaggacagacagccaccatcacctgctctggagataaattgggggaaatatgcttgctggtatcaacagcggccaggccagtcccctgtactggtcatctatctgaatagtaggcggccctctgggatccctgaccgattctctggctcccactctgggaacacagccactctgaccatcagcgggacccaggctttggatgaggctgactattactgtcaggcgtgggacaccatcactggagtaatattcggcggagggaccaggctgaccgtcctaggtcagcccaaggctgccccctcggt

SEQ ID NO: 561515 - DNA, 500 bp, Homo sapiens
  misc_feature: HIJSMM301BCGYT.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggtcgggggaccgaacggtggagttacaacgaactagtggctgcaccactctgtcttctatt

SEQ ID NO: 561516 - DNA, 522 bp, Homo sapiens
  misc_feature: HIJSMM301D7NHS.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccaccctt

SEQ ID NO: 561517 - DNA, 451 bp, Homo sapiens
  misc_feature: HIJSMM301C02K1.4.7.A07.1.454.light.4.raw
agcactgtagcacgaccggtgctcgatttagcacgtgtcgcaggggtgggaagcctgagaacacttagccttcatgagtgtccccaccatggcctggatgatgcttctcctcggactccttgcttatggatcaggagtgaattctcagactgtggtgacccaggagccatcgttctcagtgtcccctggagggacagtcacactcacttgtgacttgagctctggctcagtctctactagttactgccccagctggtaccagcagaccccaggcctgactccacgcacgctcatctacagcacaagcgctcgctcttctggggtccctgatcgcttctctggctccatccttgggaacaaagctgccctcaccatcacgggggcccaggcagatggtcagcccaaggctgccccctcggtcactctgttcccaccctcctcctacagtgct

SEQ ID NO: 561518 - DNA, 490 bp, Homo sapiens; identical to SEQ ID NO: 535234
  misc_feature: HIJSMM301C963S.17.21.B10.1.454.light.4.raw

SEQ ID NO: 561519 - DNA, 503 bp, Homo sapiens
  misc_feature: HIJSMM301EIY8C.47.55.E11.1.454.light.4.raw
agctcacgtacacgaccggtgctcgatttagcactcgcacgtagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctagggcacgtgagactcaggaaatgaccagaggggagtgaatgaggggtgcagagaactccatggctaccaggtcagcccaaggccaaccccactgtcactctgttcctaccctcctcta

SEQ ID NO: 561520 - DNA, 505 bp, Homo sapiens; identical to SEQ ID NO: 536233
  misc_feature: HIJSMM301BU2MF.48.25.C03.1.454.light.4.raw

SEQ ID NO: 561521 - DNA, 508 bp, Homo sapiens; identical to SEQ ID NO: 535835
  misc_feature: HIJSMM301A98FD.8.34.D01.1.454.light.4.raw

SEQ ID NO: 561522 - DNA, 475 bp, Homo sapiens; identical to SEQ ID NO: 537714
  misc_feature: HIJSMM301A65JK.7.81.H04.1.454.light.4.raw

SEQ ID NO: 561523 - DNA, 494 bp, Homo sapiens
  misc_feature: HIJSMM301D7SOK.41.64.F09.1.454.light.4.raw
tctatactatcacgaccggtgctcgatttagcgcgtatacaagggggaggttctttctctgggatgtggcatgagcaaaactgacaagtcaaggcaggaagatgttgccatcacaactcattgggtttctgctgctctgggttccagtctccaggggtgaaattgtgctgactcaatctccagactttcagtctgtgactccaaaggagaaagtcaccatcacctgccgggccagtcagagcattggttatagcttacactggtaccagcagaaaccagatcagcctccaaagctcctcatcaagtatgcttcccagtccatctcaggggtcccctcgaggttcagtggcagtggatctgggacagatttcaccctcaccatcaatagcctggaagctgaagatgttgcaacgtattactgtcatcagagtagtactttacctcggaccttcggccaagggacacgactggagattaaacgaactgtggctgca

SEQ ID NO: 561524 - DNA, 444 bp, Homo sapiens
  misc_feature: HIJSMM301DHDEW.4.39.D06.1.454.light.4.raw
agcactgtagcacgaccggtgctcgatttagtgacatctcgcagttctttggggcttctcctggtctctggtgacatccagctgacccagtcgccctccaccgtgtctgcatccgtaggagacagagtcaccatcacctgtcgggccagtcagaatatttacagttggttggcctggtatcaccagagaccaggagaagccccaaacctcctcatttatgatgcctccactttgaatggaggggtcccaccaacattcagcggcagtggatctgggacagagttcactctaaccatcagcagcctgcagcctgatgatcttggaacttatttctgccagcaatataatagttattggacgttcggccaggggaccaaggtcgaaatgagacgaactgtggctgcaccatctgtcttcatcttcccgccatctgactacagtgct

SEQ ID NO: 561525 - DNA, 507 bp, Homo sapiens
  misc_feature: HIJSMM301BYUGP.48.73.G07.1.454.light.4.raw
agtatacatacacgaccggtgctcgatttagctctacgctcagggcacgaccggtgctcgatttagagagagtgtgttgggtttgggggctgtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactaatcactggggcccaggtggaggatgaaggtgactacttctgtttctcaacagacaccagtgacaatcatgcgattttcggcggagggaccaagctgaccgtccg

SEQ ID NO: 561526 - DNA, 481 bp, Homo sapiens
  misc_feature: HIJSMM301EK0QV.48.43.D10.1.454.light.4.raw
agtatacatacacgaccggtgctcgatttagactagcagtaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgctgctcatatgcaggcagctacacttgggtgttcggcggagggaccaagctgaccgtcctaggtcacg

SEQ ID NO: 561527 - DNA, 486 bp, Homo sapiens; identical to SEQ ID NO: 535290
  misc_feature: HIJSMM301DD8WC.3.12.B01.1.454.light.4.raw

SEQ ID NO: 561528 - DNA, 506 bp, Homo sapiens
  misc_feature: HIJSMM301DVFSR.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaaggcccccctctgaccgtctctgggctccaagctgaggatgaggctgattattactgcagctcatatgcaggcagcagcaatgtacttttcggcggagggaccaagctgaccgtcctgggtcagcccaaggcctgccccctcggtcta

SEQ ID NO: 561529 - DNA, 486 bp, Homo sapiens
  misc_feature: HIJSMM301BSBG4.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctgttcccgccctcctcgcctacgtaga

SEQ ID NO: 561530 - DNA, 492 bp, Homo sapiens; identical to SEQ ID NO: 535425
  misc_feature: HIJSMM301EIWC7.3.71.G05.1.454.light.4.raw

SEQ ID NO: 561531 - DNA, 464 bp, Homo sapiens
  misc_feature: HIJSMM301CJHIT.40.2.A02.1.454.light.4.raw
tctagcgactcacgaccggtgctcgatttagactcatctacagggggagtcagacccactcaggacacagcatggacatgagggtccccgctcagctcctggggctcctgctgctctggctcccaggcgccagatgtgccatccagatgacccagtctccatcctcactgtctgcatctgtaggagacagagtcaccatcacttgccgggcaagtcagggcattggaaatgatttagcctggtatcagcagaaaccaggaaaagcccctcagctcctgatctatactgcatccactttacaaagtggagtcccatcaaggttcagcggcagtggatctggcacagatttcactctcaccatcagcagcctgcagcctgaagattttgctaacttattactgtctacaagattaacaattaccctcggtacttttggccagggacctggctggagatcaaacgaa

SEQ ID NO: 561532 - DNA, 508 bp, Homo sapiens
  misc_feature: HIJSMM301ASHLC.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaaggaccaaggtggaagtcaagcgaactgtggctgcaccatctgtcttcatccttcccgcc

SEQ ID NO: 561533 - DNA, 504 bp, Homo sapiens
  misc_feature: HIJSMM301A1F1M.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaaattgagatcaaacgaaactgtggctgcaccatctgtcttcatcttccgcc

SEQ ID NO: 561534 - DNA, 489 bp, Homo sapiens; identical to SEQ ID NO: 535139
  misc_feature: HIJSMM301CDE85.14.55.E11.1.454.light.4.raw

SEQ ID NO: 561535 - DNA, 472 bp, Homo sapiens
  misc_feature: HIJSMM301AMU85.43.50.E06.1.454.light.4.raw
tgtgagtagtcacgaccggtgctcgatttagatctactgacaacacacaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggaccgttcgtccgacgggaccgacggtcggagtgtc

SEQ ID NO: 561536 - DNA, 496 bp, Homo sapiens; identical to SEQ ID NO: 537925
  misc_feature: HIJSMM301ECH2X.22.14.B03.1.454.light.4.raw

SEQ ID NO: 561537 - DNA, 493 bp, Homo sapiens
  misc_feature: HIJSMM301CNMDR.47.78.H01.1.454.light.4.raw
agctcacgtacacgaccggtgctcgatttagtgtgagtagtttgggtttggggtgatcaggactcctcagttcaccttctcacaatgaggctccctgctcagctcctggggctgctaatgctctgggtcccagatccagtggggatgttgtgatgactcagtctccactctccctgtccgtcacccttgcacagccggcctccatctcctgttggtctggtcaaggcctcgaatacagtgatggaaacacctgcttgaattgctttcaccagaggccaggcccatctccaaggcgcctaatttataagctttctaaccgggactctggggtcccagacagattcagcggcagtggcactgatgtcacactgacaatcagcagggtggaggctgaggatgttgggtttgttcctccatgcaaggtacacactggccttttggtccaggggaccaacctggagatcaaatgaactgtggctgcaccatctgtctt

SEQ ID NO: 561538 - DNA, 506 bp, Homo sapiens
  misc_feature: HIJSMM301DXPUQ.8.33.C11.1.454.light.4.raw
ctcgcgtgtccacgaccggtgctcgatttagagtgagctcgttgggtttgggggaactgctcagttaggacccagagggaaccatggaagccccagctcagcttctcttcctcctgctactctggctcccagtttcagataccaccggagagattgtgttgacacatctccagccaccctgtctttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccgggggccactttcggccctgggaccaaagtggatatcaaacgaactgtggctgcaccatctgtcttcatt

SEQ ID NO: 561539 - DNA, 504 bp, Homo sapiens
  misc_feature: HIJSMM301B3KJZ.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaattagagatcaaacgaactgtggctgcaccatctgtcttcatcttcccgcc

SEQ ID NO: 561540 - DNA, 498 bp, Homo sapiens
  misc_feature: HIJSMM301A118M.43.34.D01.1.454.light.4.raw
tgtgagtagtcacgaccggtgctcgatttagatcgtctgtgttgggtttgggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacactttatgtcttcggaattgggacgacggtcaccgtcctaggtcagcccaaggccaacccca

SEQ ID NO: 561541 - DNA, 503 bp, Homo sapiens
  misc_feature: HIJSMM301C8XMN.43.69.G03.1.454.light.4.raw
tgtgagtagtcacgaccggtgctcgatttagtcgctgcgtaaaggagaaaggggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcggggggaccaagctgaccgtcctaggtcagcccaaggctgccccctcggtccta

SEQ ID NO: 561542 - DNA, 517 bp, Homo sapiens
  misc_feature: HIJSMM301B3A3C.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggctgccccctcggtcactctgttcccgccctcctccacg

SEQ ID NO: 561543 - DNA, 486 bp, Homo sapiens
  misc_feature: HIJSMM301B8GCA.19.71.G05.1.454.light.4.raw
tactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttatattgtcaacaatattattatacttcgtggacgttcggccaagggaccaaaggtggatatcagacgaa

SEQ ID NO: 561544 - DNA, 499 bp, Homo sapiens
  misc_feature: HIJSMM301ATA8V.52.33.C11.1.454.light.4.raw
cgcagtacgacacgaccggtgctcgatttagagtgagctcgttgggtttggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtattagcaactacttagcctggtaccaacagaaacctggccaggctcccaggctcctcatctatgatgcgtccaacagggccactggcatcccagccaggttcagtggcggtgggtctgggacagacttcactctcaccatcagcagcctagagcctgaagattttgcagtttattactgtcagcagcgtagcaactggcctccgatcaccttcggccaagggacacgactggagattaaacgaactgtggctgcaccatctgtcttcatt

SEQ ID NO: 561545 - DNA, 511 bp, Homo sapiens
  misc_feature: HIJSMM301AQFZQ.19.67.G01.1.454.light.4.raw
tactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttctccacctccaagaaacaaaaacttcttagcctggtaccaacagagaccaggacagcctcctaagttgctcatttactgggcttctacgcgcgaattcggggtccctgaccgattccggggcagcgggtctgggacagatttcactctcaccatcagcagcctgcaggctgaagatgtggcagtttattactgtcagcaattatttttcttatcctccgtggacgttcgccaagggaccgagggtaggaaagtacagacgaaactcgtggctgcaccat

SEQ ID NO: 561546 - DNA, 512 bp, Homo sapiens; identical to SEQ ID NO: 555754
  misc_feature: HIJSMM301D42BE.10.80.H03.1.454.light.4.raw

SEQ ID NO: 561547 - DNA, 508 bp, Homo sapiens
  misc_feature: HIJSMM301DWPDO.8.42.D09.1.454.light.4.raw
ctcgcgtgtccacgaccggtgctcgatttagacacatacgcagggaaaggggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcggcggagggaccaagttgaccgtcctaggtcagcccaaggctgccccctggtcactctgttcccgccct

SEQ ID NO: 561548 - DNA, 502 bp, Homo sapiens; identical to SEQ ID NO: 551357
  misc_feature: HIJSMM301DCD2V.9.12.B01.1.454.light.4.raw

SEQ ID NO: 561549 - DNA, 501 bp, Homo sapiens; identical to SEQ ID NO: 546428
  misc_feature: HIJSMM301C9EYC.48.8.A08.1.454.light.4.raw

SEQ ID NO: 561550 - DNA, 496 bp, Homo sapiens; identical to SEQ ID NO: 536690
  misc_feature: HIJSMM301CCLZM.40.23.C01.1.454.light.4.raw

SEQ ID NO: 561551 - DNA, 454 bp, Homo sapiens; identical to SEQ ID NO: 535005
  misc_feature: HIJSMM301DM2KW.19.86.H09.1.454.light.4.raw

SEQ ID NO: 561552 - DNA, 505 bp, Homo sapiens
  misc_feature: HIJSMM301AW5FS.43.3.A03.1.454.light.4.raw
tgtgagtagtcacgaccggtgctcgatttagagagcgtcacagggggtagctcaggaagcagagcctggagcatctccactatggcctgggctccactacttctcaccctcctcgctcactgcacaggttcttgggccagttttatgctgactcagccccactctgtgtcggagtctccggggaagacggtaaccatctcctgcacccgcagcggtggctttattgccagcaataatatgcagtggtaccagcagcgcccgggcagtccccccacactgtgatctatgaggatgaccaaagaccctctggggtccctaatcggttctctggctccgtcgacacctcctccaactctgcctacctcaccatctctggactgaagactgaggacgaggctgactattactgtcactcttatgatcgcaacaacagggtgttcggcggagggaccaggttgaccgtccttggtcagcccaaggctgccccctggtcactctgttcccg

SEQ ID NO: 561553 - DNA, 492 bp, Homo sapiens; identical to SEQ ID NO: 548815
  misc_feature: HIJSMM301BK67G.22.65.F10.1.454.light.4.raw

SEQ ID NO: 561554 - DNA, 488 bp, Homo sapiens
  misc_feature: HIJSMM301D7YOS.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttatctccagcgttcggccaggggaccaaggtggaagtcaagcgaactgtggctgcaccatctgtt

SEQ ID NO: 561555 - DNA, 490 bp, Homo sapiens; identical to SEQ ID NO: 541244
  misc_feature: HIJSMM301D2HQW.41.44.D11.1.454.light.4.raw

SEQ ID NO: 561556 - DNA, 499 bp, Homo sapiens
  misc_feature: HIJSMM301BPA5U.12.38.D05.1.454.light.4.raw
atacgacgtacacgaccggtgctcgatttagtatctgatagttgggtttgggggaactgctcagttaggacccagacggaaccatggaagccccagcgcagcttctcttcctcctgctactctggctcccagattcctctggagaagttgtgatgacgcagtctccagccaccctgtctgcgtctccaggggaaagagtcaccctctcatgcagggccagtgagattgttaccaccaacttagcctggtaccaacagaaacctggccagcctcccaggctcctcatttatggtgcatccacaagggccgctggtgtcccagccaggttcagtggcagtggatctgcgacagagttcactctcaccgtcagcagcctgcagtctgaagattttgctagtttattactgtcagcagtatgagaagtggttcaagactttcggcggagggaccgaaggtggaggatcaaacgaactgtggctgcaccatctgtcttcattcc

SEQ ID NO: 561557 - DNA, 487 bp, Homo sapiens
  misc_feature: HIJSMM301CP40X.9.59.F04.1.454.light.4.raw
tgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtgggagactcagtcaccatcaattgtcgggcgagtcaggatgttggcgaccgcttagtctggtatcagcagaaaccaggaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacaggctgcccccaaccttcggccaggggacacgactggagattaaacgaactgtggctgcaccat

SEQ ID NO: 561558 - DNA, 478 bp, Homo sapiens
  misc_feature: HIJSMM301C9M92.4.10.A10.1.454.light.4.raw
agcactgtagcacgaccggtgctcgatttagcgtcgatctcaggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggcattttcagttatttagcctggtatcagcaaaaaccagggaaagcccctaagctcctgatctatggtgcatccactttgcaaagtggggtcccatcaaggttcagcggcagtggatctgggacagatttcactctcaccatcagcagcctacagcctgaagattttgcaacttattactgtcaacagcttaataattacgcgctcactttcggcggagggaccaaggtggagatcaaacgaactagtggctgcaccaat

SEQ ID NO: 561559 - DNA, 505 bp, Homo sapiens
  misc_feature: HIJSMM301DU5CC.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggacaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaactccactgtcactctgtt

SEQ ID NO: 561560 - DNA, 491 bp, Homo sapiens; identical to SEQ ID NO: 535194
  misc_feature: HIJSMM301CGVR4.26.78.H01.1.454.light.4.raw

SEQ ID NO: 561561 - DNA, 483 bp, Homo sapiens; identical to SEQ ID NO: 535317
  misc_feature: HIJSMM301DI28B.4.1.A01.1.454.light.4.raw

SEQ ID NO: 561562 - DNA, 479 bp, Homo sapiens; identical to SEQ ID NO: 557540
  misc_feature: HIJSMM301DVN1X.48.28.C06.1.454.light.4.raw

SEQ ID NO: 561563 - DNA, 488 bp, Homo sapiens; identical to SEQ ID NO: 540342
  misc_feature: HIJSMM301EOSRA.43.33.C11.1.454.light.4.raw

SEQ ID NO: 561564 - DNA, 488 bp, Homo sapiens; identical to SEQ ID NO: 544442
  misc_feature: HIJSMM301ENI4O.19.57.F02.1.454.light.4.raw

SEQ ID NO: 561565 - DNA, 501 bp, Homo sapiens
  misc_feature: HIJSMM301C5SKL.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcgtccaggacgaacggtaggagtatacagacgaactagtggtcgtgt

SEQ ID NO: 561566 - DNA, 489 bp, Homo sapiens; identical to SEQ ID NO: 536663
  misc_feature: HIJSMM301D9P7Q.16.72.G06.1.454.light.4.raw

SEQ ID NO: 561567 - DNA, 518 bp, Homo sapiens
  misc_feature: HIJSMM301CPYBA.40.46.E02.1.454.light.4.raw
tctagcgactcacgaccggtgctcgatttagactcatctacagggaaaggggggcctaaggaagcagcactggtggtgcctcagccatggcctggaccgttctcctcctcggcctcctctctcactgcacagggtctgtgacctcctatgtgctgactcagccactctcggtgtctgtggccccaggacaggcggccaatgttacctgtgggggagacaacattgggagtaaaagtgtgcactggtaccagctgaagccaggccaggcccctgtgttggtcgtctttggacatggtgcccgaccctcggggatccctgagcgattctctgcctccaggtctgggaacacggccaccctgaccatcaccagggtcgaggccggagatgaggccgactatttttgtcacgtgtggcacgttagtcatcacgtcttcggaactgggaccacggtcaccgtcctaagtcagcccaaggccaaccccactgtcactctgttcccaccctcctcagtcgctaga

SEQ ID NO: 561568 - DNA, 494 bp, Homo sapiens; identical to SEQ ID NO: 554249
  misc_feature: HIJSMM301DQJY8.10.33.C11.1.454.light.4.raw

SEQ ID NO: 561569 - DNA, 489 bp, Homo sapiens; identical to SEQ ID NO: 535091
  misc_feature: HIJSMM301EMCOC.47.36.D03.1.454.light.4.raw

SEQ ID NO: 561570 - DNA, 502 bp, Homo sapiens; identical to SEQ ID NO: 541971
  misc_feature: HIJSMM301EFHJM.4.39.D06.1.454.light.4.raw

SEQ ID NO: 561571 - DNA, 492 bp, Homo sapiens; identical to SEQ ID NO: 544236
  misc_feature: HIJSMM301BIB7X.12.23.C01.1.454.light.4.raw

SEQ ID NO: 561572 - DNA, 497 bp, Homo sapiens
  misc_feature: HIJSMM301DYJV1.12.37.D04.1.454.light.4.raw
atacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattcggaaatttttaaatggtttcagcagaaaccagggaaagcccctagactcctgattcacgaggcatccaattcggaaataggggtcccacgaaggttcagtggaggtggagctgggacagattttaccctcaccatcagcagcctgcagcctgaagatcttgcaacatattactgtcaacagtataataatctcccgtacacttttggccaggggaccaagctggagatcaaacgaactgtggctgcaccatctgtcttcta

SEQ ID NO: 561573 - DNA, 497 bp, Homo sapiens; identical to SEQ ID NO: 535286
  misc_feature: HIJSMM301AIUMK.18.59.F04.1.454.light.4.raw

SEQ ID NO: 561574 - DNA, 508 bp, Homo sapiens
  misc_feature: HIJSMM301DBDGM.10.27.C05.1.454.light.4.raw
catagtagtgcacgaccggtgctcgatttagacgcgatcgaagggtttggggggggtcgacaagaggcagcgctctcgggacgtctccaccatggcctgggctctgctgctcctcaccctcctcactcaggacacagggtccgtgggccctgtctgccctgactcagcctgcctccgtgtctgggtctcctggacagtcggtcaccatctcctgcactggacccagcactgatgttgggcattataaccttgtctcctggtatcaacaacgcccagacaaagccccacactcttgatttatgaagtcagtaagcggccctcaggggtttctagtcgcttctctgcctccaagtctggcaacacggcctccctgacaatctctgggctccaggctgacgacgaggctgaatattactgcagctcatatgtagatggtgcctctttcaaggttttcggcggagggaccaggctgaccgtcctaagtcagcccaaggctcgccccctcggt

SEQ ID NO: 561575 - DNA, 472 bp, Homo sapiens; identical to SEQ ID NO: 535898
  misc_feature: HIJSMM301BRIUA.15.8.A08.1.454.light.4.raw

SEQ ID NO: 561576 - DNA, 488 bp, Homo sapiens; identical to SEQ ID NO: 535861
  misc_feature: HIJSMM301CID20.14.55.E11.1.454.light.4.raw

SEQ ID NO: 561577 - DNA, 489 bp, Homo sapiens
  misc_feature: HIJSMM301CCFO3.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaggtggaggtcaaacgaactgtggctgcaccatctgtcttcat

SEQ ID NO: 561578 - DNA, 493 bp, Homo sapiens; identical to SEQ ID NO: 535084
  misc_feature: HIJSMM301CU6X0.47.64.F09.1.454.light.4.raw

SEQ ID NO: 561579 - DNA, 494 bp, Homo sapiens; identical to SEQ ID NO: 539065
  misc_feature: HIJSMM301CPL6L.11.81.H04.1.454.light.4.raw

SEQ ID NO: 561580 - DNA, 514 bp, Homo sapiens
  misc_feature: HIJSMM301C9TAY.49.23.C01.1.454.light.4.raw
agtcgagagacacgaccggtgctcgatttagtacacgtgattagggagttgggggtgggctcaggaggcagagctctgggaatctcaccatggcctggacccctctcctgctccccctcctcactttctgccacagtctctgaggcctcctatgagctgacacagtcaccctcgctgtcagtgtccccaggacaaacggccaggatcacctgctctggagatgcattgccaaaaagatatgcttattggtaccatcagaagtcaggccaggcccctgtactggtcatctatgaggacaccaaacgaccctccgggatccctacgagattctctggctccagtttagggacagtggccaccctgacagtcagtggggcccaggtggaggatgagggtgattactactgttactcaacagacattactactactcatagggtgttcggcggagggaccaagctgaccgtcctaggtcagcccaaggctgccccctcggtcactctgttcccaccct

SEQ ID NO: 561581 - DNA, 485 bp, Homo sapiens; identical to SEQ ID NO: 538533
  misc_feature: HIJSMM301BT33B.47.78.H01.1.454.light.4.raw

SEQ ID NO: 561582 - DNA, 497 bp, Homo sapiens; identical to SEQ ID NO: 549756
  misc_feature: HIJSMM301CF8HV.40.57.F02.1.454.light.4.raw

SEQ ID NO: 561583 - DNA, 447 bp, Homo sapiens; identical to SEQ ID NO: 535201
  misc_feature: HIJSMM301B43OV.18.9.A09.1.454.light.4.raw

SEQ ID NO: 561584 - DNA, 505 bp, Homo sapiens
  misc_feature: HIJSMM301A4XFM.8.28.C06.1.454.light.4.raw
ctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactgtggctgcaccatctgtcttctatcttcccgcc

SEQ ID NO: 561585 - DNA, 454 bp, Homo sapiens; identical to SEQ ID NO: 534964
  misc_feature: HIJSMM301ALY4T.19.86.H09.1.454.light.4.raw

SEQ ID NO: 561586 - DNA, 494 bp, Homo sapiens
  misc_feature: HIJSMM301CTFTP.51.57.F02.1.454.light.4.raw
cgatcgtatacacgaccggtgctcgatttagctcgatatagttgggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgt

SEQ ID NO: 561587 - DNA, 509 bp, Homo sapiens; identical to SEQ ID NO: 536047
  misc_feature: HIJSMM301DY1C1.17.33.C11.1.454.light.4.raw

SEQ ID NO: 561588 - DNA, 440 bp, Homo sapiens; identical to SEQ ID NO: 535667
  misc_feature: HIJSMM301B1FNQ.41.9.A09.1.454.light.4.raw

SEQ ID NO: 561589 - DNA, 506 bp, Homo sapiens
  misc_feature: HIJSMM301CG1Q8.15.5.A05.1.454.light.4.raw
tctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttgggggcaaagctgccctgacccttcgggtgcgcagcctgaggatgaggctgagtattactgcttgctctcctatagtggtgttcgggtgttcggcggagggaccaagctgaccgtcctaggtcagcccaaggctgcccctcggtccactctgttcccaccctcctcgctacgtaga

SEQ ID NO: 561590 - DNA, 477 bp, Homo sapiens
  misc_feature: HIJSMM301AL5Q7.48.2.A02.1.454.light.4.raw
  modified_base (455)..(455): a, c, t, g, unknown or other
agtatacatacacgaccggtgctcgatttagactcatctacagggggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagcggcagtggatctggcacagagttcactctcaccatcagcaccctgcagcctgaagattttgcgacttatttctgtctacaagattctaattaccctcggacgttcggccagggaccaaagtaggatgtnaaccgaactagtggctgcacca

SEQ ID NO: 561591 - DNA, 492 bp, Homo sapiens
  misc_feature: HIJSMM301ECLOG.5.57.F02.1.454.light.4.raw
atcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtcaacaatgtggtcagtggcctcgaacgttcggcccagggccacagtggatatcaggcgaactgtggctgcaccatctgtctt

SEQ ID NO: 561592 - DNA, 508 bp, Homo sapiens; identical to SEQ ID NO: 537871
  misc_feature: HIJSMM301AQGMQ.8.33.C11.1.454.light.4.raw

SEQ ID NO: 561593 - DNA, 421 bp, Homo sapiens; identical to SEQ ID NO: 541230
  misc_feature: HIJSMM301BIHSN.9.25.C03.1.454.light.4.raw

SEQ ID NO: 561594 - DNA, 502 bp, Homo sapiens
  misc_feature: HIJSMM301A1U56.52.36.D03.1.454.light.4.raw
cgcagtacgacacgaccggtgctcgatttagctgcgtcacgatctctcttgggggtgggctcaggaggcagagctgtgggtgtctcaccatggcgtgggccacactcctgctcccactcctcaacctctacgcaggctctgttgcctcctatgagctgacacagcttccctcggtgtcagtgtccccaggacagacagccaggatcacctgctctggagatgtactggggaaaaattatgctgactggtaccagcagaagccaggccaagcccctgagttggtgatatacgaaaatagtgagcgctaccctgggatccctgaccgattctctgggtccacctcagggaagacgaccaccctgaccatcaacagggtccggactgaagacgaggctgactattactgcttgtctgggggatgaggacacattggtgttcgggcggaggggaccaagctgaccgtcctacgtcagcccaaggctgccccctcggtcactctgtt

SEQ ID NO: 561595 - DNA, 338 bp, Homo sapiens
  misc_feature: HIJSMM301A6BWM.49.29.C07.1.454.light.4.raw
agtcgagagacacgaccggtgctcgatttagagtgctacgaagggaaaggggcttactggtaccaacaactcccaggaacggccccaaattcctcttgtataggagtaatcagcggccctcaggggtccctgaccgattctctggctcccagtctggcacctcagcctccctggccatcagtggcctccggtccgaggatgaggctgattattattgtgcagcatgggatgacagcctgagtggtctcgtcttcggagctgggaccaaggtcaccgtcctaggtcagcccaaggccaaccccactgtcactctgttcccaccctcctctctctcgact

SEQ ID NO: 561596 - DNA, 488 bp, Homo sapiens
  misc_feature: HIJSMM301ET76Q.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtggggtcccatcaaggttcagcggcagtgggtctgggacagaattcactctcaccatcagcagcctgcaacctgatgactttgcaacttattactgccaacagtataatggtatgaatccacttttggccaagggaccaagctggagatcaaacgaactgtggctgcacca

SEQ ID NO: 561597 - DNA, 520 bp, Homo sapiens; identical to SEQ ID NO: 555934
  misc_feature: HIJSMM301C64XF.5.27.C05.1.454.light.4.raw

SEQ ID NO: 561598 - DNA, 510 bp, Homo sapiens
  misc_feature: HIJSMM301AHR9A.48.53.E09.1.454.light.4.raw
agtatacatacacgaccggtgctcgatttagagagagtgtgttgggtttgggggtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctgttcccacct

SEQ ID NO: 561599 - DNA, 507 bp, Homo sapiens
  misc_feature: HIJSMM301DB40R.5.58.F03.1.454.light.4.raw
atcagacacgcacgaccggtgctcgatttagtctgatcgagaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggttatcagggcaataagcggccctcaggggtttctaatcgcttctctggctccaagtctggcaacacggccgccctgacaatctctgggctccaggctgacgacgaggctgatttttactgctgctcatatgcaggtgatcacacttttatgttcgggactgggaccaaggtcaccgtcctaggtcagcccaaggccaaccccactgtcact

SEQ ID NO: 561600 - DNA, 505 bp, Homo sapiens; identical to SEQ ID NO: 535503
  misc_feature: HIJSMM301B32CB.8.28.C06.1.454.light.4.raw

SEQ ID NO: 561601 - DNA, 481 bp, Homo sapiens; identical to SEQ ID NO: 539249
  misc_feature: HIJSMM301BLVCL.11.76.G10.1.454.light.4.raw

SEQ ID NO: 561602 - DNA, 493 bp, Homo sapiens
  misc_feature: HIJSMM301D1CWD.41.23.C01.1.454.light.4.raw
tctatactatcacgaccggtgctcgatttagtacacgtgattagggattgggggtgggtccaggaggcagaactctgggtgtctcaccatggcctggatccctctacttctccccctcctcactctctgcacaggctctgtgacctcctatgagctgacacagccaccctcggtgtcagtgtccccaggacagacggccaggatcgactgctctggagaagcattggcaacggaatatgcttattggtaccagcagaagccaggtcaggcccccatgttaataatatatagagacagtgagaggccctcagggatacctgagcgtatgtctggctccagctcagggacaacagtcacgttgaccatcactggagtccaggcagaagacgaggctgactatcactgtcaatcagcagacagtagtggttcttattgggtgttcggcggagggaccaaggctgaccgtccttggtcagcccaaggctgccccctc

SEQ ID NO: 561603 - DNA, 487 bp, Homo sapiens; identical to SEQ ID NO: 540408
  misc_feature: HIJSMM301C8SSL.41.33.C11.1.454.light.4.raw

SEQ ID NO: 561604 - DNA, 490 bp, Homo sapiens; identical to SEQ ID NO: 543909
  misc_feature: HIJSMM301C59TG.14.55.E11.1.454.light.4.raw

SEQ ID NO: 561605 - DNA, 479 bp, Homo sapiens; identical to SEQ ID NO: 538734
  misc_feature: HIJSMM301DX56O.8.53.E09.1.454.light.4.raw

SEQ ID NO: 561606 - DNA, 505 bp, Homo sapiens; identical to SEQ ID NO: 535987
  misc_feature: HIJSMM301BRF7N.18.37.D04.1.454.light.4.raw

SEQ ID NO: 561607 - DNA, 522 bp, Homo sapiens
  misc_feature: HIJSMM301DVOZ5.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagcctctggggccgagcgctacctcaccatctccagcctccagtctgaagatgaggctgactattactgtcagacatgggacgctggcgtctggctgttcggcggagggaccaagctgaccgtcctaggtcagcccaaggctcgccccctcggtacactctgttcccaccctcctcaccg

SEQ ID NO: 561608 - DNA, 496 bp, Homo sapiens
  misc_feature: HIJSMM301AK49E.51.12.B01.1.454.light.4.raw
cgatcgtatacacgaccggtgctcgatttagtagtgtagattccgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggcccaaccccactgtcta

SEQ ID NO: 561609 - DNA, 499 bp, Homo sapiens
  misc_feature: HIJSMM301BH9E6.14.64.F09.1.454.light.4.raw
cgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagcgttatcgcctatttaaattggtatcagcaaaaaccagggaaagcccctaacctcctgatctttgatgcatccaatttgcagagtggggtcccatcacgcttcactggcagtggctctgggacagatttcactctcaccatcagcggtctccaacctgaagattttgcaacttactactgtcaacagagttatgataccccgtggacgttcggccaggggaccgaaggtaggaggatcaaacgaaactgtggctgcaccactctgtcttcatcttcccg

SEQ ID NO: 561610 - DNA, 470 bp, Homo sapiens
  misc_feature: HIJSMM301D074K.8.67.G01.1.454.light.4.raw
ctcgcgtgtccacgaccggtgctcgatttagagtatacatattgggtttggggcttttcctgggctcctgctactctggctccgaggtgccagatgtgacatccagatgacccagtctccatcctccctgtctgcttctataggagacagagtcaccatcacttgccgggcaagtcagaccattagcacctttttaaattggtatcaacagagcccaggaaaagcccccaaactcctgatttatggtgcatccatttcgcaaagtgggtcccatcaaggttcagtggcagtggatctggggcagatttcaccctcaccatcagcagtctgcaacctgaagactttgcaacttactactgtcagcagtcttacagtaggccgggcacctttggccagggacgaagctggagatcgaacgaactgtggctgcaccatctgtcttcatcttcccgccatctgagacacgcgag

SEQ ID NO: 561611 - DNA, 444 bp, Homo sapiens; identical to SEQ ID NO: 535856
  misc_feature: HIJSMM301CLHT3.9.9.A09.1.454.light.4.raw

SEQ ID NO: 561612 - DNA, 447 bp, Homo sapiens; identical to SEQ ID NO: 535201
  misc_feature: HIJSMM301BK1WQ.18.9.A09.1.454.light.4.raw

SEQ ID NO: 561613 - DNA, 495 bp, Homo sapiens; identical to SEQ ID NO: 539509
  misc_feature: HIJSMM301EWYL3.26.72.G06.1.454.light.4.raw

SEQ ID NO: 561614 - DNA, 509 bp, Homo sapiens; identical to SEQ ID NO: 536047
  misc_feature: HIJSMM301BK3C4.17.33.C11.1.454.light.4.raw

SEQ ID NO: 561615 - DNA, 487 bp, Homo sapiens
  misc_feature: HIJSMM301ANP8A.12.33.C11.1.454.light.4.raw
atacgacgtacacgaccggtgctcgatttagagtgagctcgttgggtttgggggcaggagtcagtctcagtcaggacacagcatggacatgagggtccccgctcagctcctggggctcctgctactctggctccgaggtgccagatgtgacatccagatgacccagtctccttcctccctgtctgcatctgtcggagacagcgtcaccatcacttgtcgggcaagtcagaacatttacaattatttaaattggtatcagcagaaaccagggaaagcccctaaactcctgatctatcatgaatccagtttgcgaagtggagtcccatcaaggttcagtggcactgggtctgagacagagttcactctcaccatcagcactctacagcctgaagattttgctaacttattattgtcaacaaagttatgagacccctgccactttcggccctgggaccatagtggatatgaaacgaactgtggctgcacc

SEQ ID NO: 561616 - DNA, 494 bp, Homo sapiens
  misc_feature: HIJSMM301CSQZ3.4.26.C04.1.454.light.4.raw
agcactgtagcacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcaggtggatcaggcacagtattttacactagaaaatcagcagagtggaggctgaggatgttgggctctattattgcatgcaagctctacaacgtcccgctcactttcggcggacgggaccaagggtggagatacaaacgtaacg

SEQ ID NO: 561617 - DNA, 481 bp, Homo sapiens
  misc_feature: HIJSMM301AZRBO.49.27.C05.1.454.light.4.raw
agtcgagagacacgaccggtgctcgatttagacgcgatcgaagggtttgggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttacttcaccatcagcaggctgcagcctgaagatattgcaacatattactgtcaacagtatgatagtctcccgctcactttcggcgggggaccgaaggtggaggatcaagcgaacctgtgggctgcaccta

SEQ ID NO: 561618 - DNA, 491 bp, Homo sapiens
  misc_feature: HIJSMM301C11CD.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcggtctattactgtcagcagtatggtcacgtcccaagaacttttggccaggggaccaagctggagatcaaacgaactgtggctgcaccatctgtt

SEQ ID NO: 561619 - DNA, 496 bp, Homo sapiens; identical to SEQ ID NO: 536802
  misc_feature: HIJSMM301A6QX7.5.24.C02.1.454.light.4.raw

SEQ ID NO: 561620 - DNA, 447 bp, Homo sapiens; identical to SEQ ID NO: 535201
  misc_feature: HIJSMM301CWK44.18.9.A09.1.454.light.4.raw

SEQ ID NO: 561621 - DNA, 433 bp, Homo sapiens
  misc_feature: HIJSMM301BYQ0N.18.5.A05.1.454.light.4.raw
tacgagtatgcacgaccggtgctcgatttagatagatagacagggtggaaggagactgggacatccagatgacccagtctccttccaccctgtctgcatctgtaggagacagagtcaccatctcttgccgggccactcagagtattagtatctggttggcctggtatcagcagaaaccagggaaagcccctaagctcctgatcgagaaggcgtctagtttagaaagtggggtcccatcaaggtttagcggcagtggatctgggacagaattcactctcaccatcagcagcctgcagcctgatgattttgcaacttattactgccaacattataatacttattcgtacacttttggccaggggaccaagctggagatcaaacgaactgtggctgcaccatctgtcttcatcttcccgcatctgacatactcgta

SEQ ID NO: 561622 - DNA, 483 bp, Homo sapiens
  misc_feature: HIJSMM301DVQ0H.49.53.E09.1.454.light.4.raw
agtcgagagacacgaccggtgctcgatttagagagagtgtgttgggtttgggggagctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgatatgtggcagtgtattactgtcagcaatatcacactgctccgctcactttcggcggagggaccagggtggagatcaaacg

SEQ ID NO: 561623 - DNA, 468 bp, Homo sapiens
  misc_feature: HIJSMM301ERE4E.51.16.B05.1.454.light.4.raw
cgatcgtatacacgaccggtgctcgatttagagctcacgtaaggggaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatctcttgccaggcgagtcaggacattataagatatttaaattggtatcagcagaaaccagggaaagcccctaagctcctgatctacgatgcatccaatttggaaacaggggtcccatcaaggttcagtggaagtggatctgggacagtattttactttcaccatcagcagcctgcagcctgaggatcttgcaacatattactgtcaacagtatgataatcgtcccgtactacttttggccgaggggaccaagctggagatcagacgaa

SEQ ID NO: 561624 - DNA, 476 bp, Homo sapiens; identical to SEQ ID NO: 537368
  misc_feature: HIJSMM301CYC3P.7.83.H06.1.454.light.4.raw

SEQ ID NO: 561625 - DNA, 495 bp, Homo sapiens; identical to SEQ ID NO: 535007
  misc_feature: HIJSMM301EQ5EY.22.5.A05.1.454.light.4.raw

SEQ ID NO: 561626 - DNA, 508 bp, Homo sapiens
  misc_feature: HIJSMM301DJSSZ.8.33.C11.1.454.light.4.raw
ctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaaattgagatcaaacgaactgtggctgcaccatctgtcttcatt

SEQ ID NO: 561627 - DNA, 500 bp, Homo sapiens; identical to SEQ ID NO: 542309
  misc_feature: HIJSMM301B0NTZ.12.86.H09.1.454.light.4.raw

SEQ ID NO: 561628 - DNA, 490 bp, Homo sapiens; identical to SEQ ID NO: 543909
  misc_feature: HIJSMM301AWQC8.14.55.E11.1.454.light.4.raw

SEQ ID NO: 561629 - DNA, 489 bp, Homo sapiens; identical to SEQ ID NO: 535139
  misc_feature: HIJSMM301AVZJI.14.55.E11.1.454.light.4.raw

SEQ ID NO: 561630 - DNA, 507 bp, Homo sapiens
  misc_feature: HIJSMM301A7TFB.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggcggggggaccgaaggtggagttacgtaaacgaaactgtggctgcaccatctgtctttatcttccccg

SEQ ID NO: 561631 - DNA, 501 bp, Homo sapiens; identical to SEQ ID NO: 536142
  misc_feature: HIJSMM301AGUO3.15.1.A01.1.454.light.4.raw

SEQ ID NO: 561632 - DNA, 494 bp, Homo sapiens
  misc_feature: HIJSMM301ATBK1.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatacaaggagcaccactctcgtggtatttggtggagggaccaagctgaccgtcctaggtcagcccaaggctgccccctcggtcactctgttcccgccctcctcga

SEQ ID NO: 561633 - DNA, 507 bp, Homo sapiens
  misc_feature: HIJSMM301CSN4J.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggccgtccgggggccactttcggccctgggaccaaagtggatatcaaacgaactcgtggctgcaccatctgtctt

SEQ ID NO: 561634 - DNA, 504 bp, Homo sapiens
  misc_feature: HIJSMM301B6IAD.40.67.G01.1.454.light.4.raw
tctagcgactcacgaccggtgctcgatttagagtatacatattgggtttggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaagcctggccaggctcccagactcctcatctatgatgcgtcttccagggccactggcgtcccggccaggttcagtggcagtgggtctgggacagccttcactctcaccatcagcagcctggagcccgaagattttgcggtttattactgtcagcagcgtgccgactggccccctcacgttcggcggagggaccaaggtggacatcaaacgaactgtggctgcaccatctgtcttcatcttcccgcc

SEQ ID NO: 561635 - DNA, 500 bp, Homo sapiens; identical to SEQ ID NO: 553383
  misc_feature: HIJSMM301C8DPG.18.11.A11.1.454.light.4.raw

SEQ ID NO: 561636 - DNA, 479 bp, Homo sapiens; identical to SEQ ID NO: 535586
  misc_feature: HIJSMM301BDMCB.13.34.D01.1.454.light.4.raw

SEQ ID NO: 561637 - DNA, 477 bp, Homo sapiens
  misc_feature: HIJSMM301BFA61.51.76.G10.1.454.light.4.raw
cgatcgtatacacgaccggtgctcgatttagtcactcatacaggggaactgctcagttaggacccagacggaaccatggaagccccagcgcagcttctcttcctcctgctactctggctcccagataccactggagaagtagtgatgacgcagtctccagccaccctgtctgtgtctccaggggaaaggccaccctctcctgcagggccagtcagagtgttagcagcgacttagcctggtaccagcagaaacctggccaggctcccaggctcctcatctatgatgcatccacaagggccactgatatcccagccaggttcagtggcagtgggtctgggacagagttcactctcaccatcagcagcctgcagtctgaagattttgcaatttattactgtcagcagtataataactggcctccgtacacttttggccaggggaccaagctggagatcaaacgaactgtggctgcaccat

SEQ ID NO: 561638 - DNA, 504 bp, Homo sapiens; identical to SEQ ID NO: 551974
  misc_feature: HIJSMM301DHKGJ.19.78.H01.1.454.light.4.raw

SEQ ID NO: 561639 - DNA, 490 bp, Homo sapiens
  misc_feature: HIJSMM301ADTE2.7.85.H08.1.454.light.4.raw
cgtgtctctacacgaccggtgctcgatttagtatcactcagtcgcggggtccaaacagagcttcagcaaacatagtgggaatctgcaccatgccctgggctctgctcctcctgaccctcctcactcactctgcagtgtcagtggtccaggcagggctgactcagccaccctcggtgtccaagggcctgcgacagaccgcaacactcacctgcactgggagcagcaacgatgttggcagggagggagcagcttggctgcagcaacacgagggccaccctcccaaactcctctcctacaggaataacgagcggccctcagggatctcagagagattctctgcatccaggtcaggaaacacagcctccctgaccattactggactccagcctgaggacgaggctgactattactgctcagcatgggacagcggcctcaggacttatgtcttcggaactcgggacccacgttaccgtcctaggtcacgaccccg

SEQ ID NO: 561640 - DNA, 506 bp, Homo sapiens
  misc_feature: HIJSMM301DFSB6.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcggccaagggaccaaggtaggaaagtcaaacgaactagtggctgcaccatctgtcttcatcttccccg

SEQ ID NO: 561641 - DNA, 477 bp, Homo sapiens
  misc_feature: HIJSMM301CL143.26.72.G06.1.454.light.4.raw
agactatactcacgaccggtgctcgatttagctacgactgcaagggaaagggtgagatccctcactgtggctcactttcagcggagggaccacggtggagatcacacgtaagtgcactttcctaatgctttttcttataaggttttaagtttggagcgtttttgtgtttgagatgttagctcaggtcaattccaaagagtaccagattctttcaaaaagtcagatgagtaagggatagaaattagttcaccttaaggaacagccaagcgctagccagttaagtgaggcatctcaattgcaaggttttctctgcatcggtcaggttagtgatattaacagcgaaaagagatttttgttaaggggaaagtaatgaagttaacactgtggatcaccttcggccaagggacacgactggagattaaacgaactgtggctgcaccatctgtcttcatcttcccgccatctgaagtatagtct

SEQ ID NO: 561642 - DNA, 509 bp, Homo sapiens; identical to SEQ ID NO: 539359
  misc_feature: HIJSMM301A2CH1.47.85.H08.1.454.light.4.raw

SEQ ID NO: 561643 - DNA, 490 bp, Homo sapiens
  misc_feature: HIJSMM301ELPAV.12.31.C09.1.454.light.4.raw
atacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctccctgtctgcatctgtaggagacaaagtcaccatcacttgccgggctaacgagagtattgccacgtatttaaattggtatcaacaaaaagcaggcaaagtcccaaagctcctgatttatgctgccaccagtctgcaaggtgggttcccgtcaaggttcactggccgtggatcagggacagaatttactctcaccatcagtagtctacagcctgaagatattgctacttattactgtcagcagagttaccgcgctcccatcactttcggccaagggacacgaaccgcagaattggacgaactgtggctgcacc

SEQ ID NO: 561644 - DNA, 485 bp, Homo sapiens; identical to SEQ ID NO: 535880
  misc_feature: HIJSMM301EWEZK.7.75.G09.1.454.light.4.raw

SEQ ID NO: 561645 - DNA, 514 bp, Homo sapiens; identical to SEQ ID NO: 546238
  misc_feature: HIJSMM301BCLNK.47.85.H08.1.454.light.4.raw

SEQ ID NO: 561646 - DNA, 507 bp, Homo sapiens
  misc_feature: HIJSMM301EMQZI.17.33.C11.1.454.light.4.raw
cgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttccc

SEQ ID NO: 561647 - DNA, 516 bp, Homo sapiens
  misc_feature: HIJSMM301AKHS9.47.86.H09.1.454.light.4.raw
agctcacgtacacgaccggtgctcgatttagtgctatagacttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctctgggatccccgagcgattctctggctccaagtctgggaacacggccaccctgaccgtcagcagggtcgacgtcggggatgaggccgtatattttgtcaggtgtgggagactaattttggtcatatgttgttcggcggagggaccaagctgaccgtcctcggtcagcccaaggctgccccctcggtcactctgttcccaccctcct

SEQ ID NO: 561648 - DNA, 509 bp, Homo sapiens
  misc_feature: HIJSMM301AGG4Q.9.12.B01.1.454.light.4.raw
  modified_base (430)..(430): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttcncgggcgttcggccaagggaccaacggtggaaagtcaaaacgaacctagtggcgtgcaccatctgtcttcatcttccccg

SEQ ID NO: 561649 - DNA, 460 bp, Homo sapiens; identical to SEQ ID NO: 537107
  misc_feature: HIJSMM301BHFIW.22.28.C06.1.454.light.4.raw

SEQ ID NO: 561650 - DNA, 496 bp, Homo sapiens; identical to SEQ ID NO: 535423
  misc_feature: HIJSMM301AHOAH.3.33.C11.1.454.light.4.raw

SEQ ID NO: 561651 - DNA, 485 bp, Homo sapiens; identical to SEQ ID NO: 536576
  misc_feature: HIJSMM301A4AGU.46.35.D02.1.454.light.4.raw

SEQ ID NO: 561652 - DNA, 510 bp, Homo sapiens
  misc_feature: HIJSMM301DUJ5R.17.2.A02.1.454.light.4.raw
cgtagactagcacgaccggtgctcgatttagactcatctacagggggggtagagaagacaggactcaggacaatctccagcatggccagcttccctctcctcctcaccctcctcactcactgtgcagggtcctgggcccagtctgtactgactcagccaccctcagcgtctgggacccccggacagagggtcaccatctcttgttctggaagcagctccaacatcgggactaatactgtaacctggttccagcacgtcccaggaacggccccaaactcgtcatgtataattatagtcagcggccctcaggggtccctgaccgattcgctggctccaactctggcacctcagcctccctggccatcagtgggctccagtctgaggatgaggctgattattactgtgcagcatgggatgccagcctgagtagtcccgtcttcggaactgggaccaaggtcaccgtcctacgtcagcccaaggccaaccccactgtcactctgttcccaccct

SEQ ID NO: 561653 - DNA, 443 bp, Homo sapiens
  misc_feature: HIJSMM301EPIST.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgttcccacctcctcgacacgcgag

SEQ ID NO: 561654 - DNA, 498 bp, Homo sapiens
  misc_feature: HIJSMM301CC42O.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctcgatcgattctctggctccaagtctggcaacacggcctccctgaacatctctgggctccaggctgaggatgaggctgattattattgctgctcatatggaagtacctactcttttctcttggaacgtgggaccacggtcgacctcctaggtcagcccaacggccaacccca

SEQ ID NO: 561655 - DNA, 489 bp, Homo sapiens; identical to SEQ ID NO: 536013
  misc_feature: HIJSMM301AG5FN.26.23.C01.1.454.light.4.raw

SEQ ID NO: 561656 - DNA, 454 bp, Homo sapiens; identical to SEQ ID NO: 536325
  misc_feature: HIJSMM301ALF3X.19.86.H09.1.454.light.4.raw
  modified_base (436)..(436): a, c, t, g, unknown or other

SEQ ID NO: 561657 - DNA, 506 bp, Homo sapiens; identical to SEQ ID NO: 534969
  misc_feature: HIJSMM301EZM17.18.37.D04.1.454.light.4.raw

SEQ ID NO: 561658 - DNA, 494 bp, Homo sapiens
  misc_feature: HIJSMM301BTBYK.9.1.A01.1.454.light.4.raw
  modified_base (471)..(471): a, c, t, g, unknown or other
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgnaccatctgtcttcatcttccccg

SEQ ID NO: 561659 - DNA, 495 bp, Homo sapiens
  misc_feature: HIJSMM301E0A8E.13.87.H10.1.454.light.4.raw
tcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagcaaaaaaccagggaaagtccctaagctcctgatctatgttgcatccactttgcaaagtggggtcccatcaaggttcagcggcagtggatctgggacagaattcactctcacaatcagcagcctgcagcctgaagattttgcaaacttattaactgtcaacagcttaaatagttacccgctcagtttcggcggagggaccaaggtggagaatcaaaacgaactgtggctgcaccatctgtcttcta

SEQ ID NO: 561660 - DNA, 507 bp, Homo sapiens
  misc_feature: HIJSMM301AIUXS.9.12.B01.1.454.light.4.raw
tgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggtccgaaggaccgaacggtaggaaagtacaaacgaactacgtggctgcaccta

SEQ ID NO: 561661 - DNA, 515 bp, Homo sapiens
  misc_feature: HIJSMM301AYT5J.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcggtccaagggacccgaaggtagggaaagtacaaaacgaaacctagtggcgtgcaccatctgtcttcatcttccccg

SEQ ID NO: 561662 - DNA, 479 bp, Homo sapiens; identical to SEQ ID NO: 545213
  misc_feature: HIJSMM301BXUIM.40.59.F04.1.454.light.4.raw

SEQ ID NO: 561663 - DNA, 512 bp, Homo sapiens
  misc_feature: HIJSMM301BNN2X.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcggtccacggaccgaacggtaggaaagtacaagcgaaactcgtggctgcaccactctgtcttctactcttcccgt

SEQ ID NO: 561664 - DNA, 503 bp, Homo sapiens; identical to SEQ ID NO: 541454
  misc_feature: HIJSMM301COHBI.9.12.B01.1.454.light.4.raw

SEQ ID NO: 561665 - DNA, 498 bp, Homo sapiens
  misc_feature: HIJSMM301DW73U.52.78.H01.1.454.light.4.raw
cgcagtacgacacgaccggtgctcgatttagtgtgagtagtttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgacaaggtcacgtcctgggtcagcccaaggccaacccactgtcactctcg

SEQ ID NO: 561666 - DNA, 491 bp, Homo sapiens; identical to SEQ ID NO: 535294
  misc_feature: HIJSMM301A39J8.16.68.G02.1.454.light.4.raw

SEQ ID NO: 561667 - DNA, 509 bp, Homo sapiens; identical to SEQ ID NO: 543266
  misc_feature: HIJSMM301BU9JM.17.33.C11.1.454.light.4.raw

SEQ ID NO: 561668 - DNA, 509 bp, Homo sapiens; identical to SEQ ID NO: 541829
  misc_feature: HIJSMM301A9PCG.17.28.C06.1.454.light.4.raw

SEQ ID NO: 561669 - DNA, 491 bp, Homo sapiens; identical to SEQ ID NO: 535294
  misc_feature: HIJSMM301D1ZCU.16.68.G02.1.454.light.4.raw

SEQ ID NO: 561670 - DNA, 459 bp, Homo sapiens; identical to SEQ ID NO: 536529
  misc_feature: HIJSMM301DS6FR.11.86.H09.1.454.light.4.raw

SEQ ID NO: 561671 - DNA, 482 bp, Homo sapiens
  misc_feature: HIJSMM301BQAD3.40.59.F04.1.454.light.4.raw
tctagcgactcacgaccggtgctcgatttagtacacacacttagggattgggggcctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagaccccg

SEQ ID NO: 561672 - DNA, 487 bp, Homo sapiens
  misc_feature: HIJSMM301BI54M.43.36.D03.1.454.light.4.raw
  modified_base (441)..(441): a, c, t, g, unknown or other
tgtgagtagtcacgaccggtgctcgatttagctgcgtcacgatctctcttgggggagctacaacaggcaggcaggggcagcaagatggtgttgcagacccaggtcttcatttctctgttgctctggatctctggtgccttcggggacatcgtgatgacccagtctccaggttccctggctgtctctctgggcgagagggccacgctcaagtgcacctccagcgagagtgtgttgtatccccccaccatcagcacgccttagcctggtaccagcacaagtcagggcagcctcctaagttgctcttttactggacttcgatccgcgcatctggggtccctgaccgattcatgggcagcggctctgggacagacttcgctctcaccatcaacagcctccaggctgaggatgcggcggttttatattgtcaacaattattttagngctccgtacacttttggccaggggaccaaggttggagatcaaacga

SEQ ID NO: 561673 - DNA, 476 bp, Homo sapiens
  misc_feature: HIJSMM301D27SF.4.32.C10.1.454.light.4.raw
agcactgtagcacgaccggtgctcgatttagtatagacatcaacacacaaagggggcaggagtcagactcagtcaggacacagcatggacatgagggtccccgctcagctcctggggctcctgctgctctggctcccaggtgccaaatgtgacatccagctgacccagtctccctccaccctgtctgcatctataggagacagagtcaccatcacttgccgggccagtcagagtattagtaactggttggcctggtatcagcagaaaccaggcaaagccccaaagctccttatctctgatgcctccactttgcacggtggcgtcccaccaacgttcagcggcagtggatctgggacagaattcactctcaccatcagcagcctgcagcctgatgatgttgcaacttattactgtcaacaatataacagttattggacgttcggccaagggaccaaggtggaaatcagacgaactgt

SEQ ID NO: 561674 - DNA, 511 bp, Homo sapiens
  misc_feature: HIJSMM301B3I7K.19.85.H08.1.454.light.4.raw
tactctcgtgcacgaccggtgctcgatttagtatcactcagtcgcgggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgaccaaccggccctcaaacatttcagagagattttctacctccaggacacaaaatacagccctctctgaccattactggtctccagcctgacgacgaggctgactactactgctcagcctgggacaccagcctcgctgcttggcttttcggcggagggaccaagctgaccgtcctgggtcacgcccaaggctcgccccctcggtccta

SEQ ID NO: 561675 - DNA, 514 bp, Homo sapiens
  misc_feature: HIJSMM301CKH5D.17.37.D04.1.454.light.4.raw
cgtagactagcacgaccggtgctcgatttagtagcatactgttgggtttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccagggcagacggccaggattacctgtgggggaaacaatgttggaagtaaaactgtgcactggtaccagcagaagccaggccaggcccctgtgctggtcgtctatgatgataccgaccggccctcagggatccctgagcgattctctggctccaactctgggaacacggccaccctgaccatcggcagggtcgaagccggggatgaggccgactattattgtcaggtgtgggatagtagtagtgatcatgtggtattcggcggagggaccaaggctgaccgtccttggtcagcccaaggctgccccctcggtcactctgttcccg

SEQ ID NO: 561676 - DNA, 478 bp, Homo sapiens; identical to SEQ ID NO: 555043
  misc_feature: HIJSMM301DVH4W.52.1.A01.1.454.light.4.raw

SEQ ID NO: 561677 - DNA, 513 bp, Homo sapiens
  misc_feature: HIJSMM301AEX5I.7.34.D01.1.454.light.4.raw
cgtgtctctacacgaccggtgctcgatttagatcgtctgtgttggggtttggggggggtcgtcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggactccagactgaggacgaggctgattattactgctgctcatatacaggggacagcattatttgggtgttcggcggagggaccaagctgaccgtcctgcgtcagcccaaggctgccccctcggtcact

SEQ ID NO: 561678 - DNA, 505 bp, Homo sapiens; identical to SEQ ID NO: 536117
  misc_feature: HIJSMM301BRAHS.8.71.G05.1.454.light.4.raw

SEQ ID NO: 561679 - DNA, 503 bp, Homo sapiens; identical to SEQ ID NO: 537226
  misc_feature: HIJSMM301DYTL5.19.85.H08.1.454.light.4.raw

SEQ ID NO: 561680 - DNA, 490 bp, Homo sapiens
  misc_feature: HIJSMM301BKS0D.51.20.B09.1.454.light.4.raw
cgatcgtatacacgaccggtgctcgattagtgtagtgtgaagggggagctacaacaggcaggcaggggcagcaagatggtgttgcagtcccaggtcttcatttctctgttgctctggatctctgtactgcctacaggtgcctacggggagatcgtgctgacccagtctccagactccctggctgtgtctctgggcgagagggccaccatcaactgcgagtccagccggaatcttttatacagccccaacaataagaactacttagcttggtaccagcagaaaccaggacagcctcctaagctcctcatttactgggcatctacccgggaatccggggtccctgaccgattcagtggcagcgggtctgggacagatttcactctcaccatcagcagcctgcaggctgaggatgtggcagtttattactgtcaacaatattatagtcctcctcagacttttggccaggggaccaagctggagatcaaacgaa

SEQ ID NO: 561681 - DNA, 507 bp, Homo sapiens
  misc_feature: HIJSMM301BAFV3.3.79.H02.1.454.light.4.raw
agacgcactccacgaccggtgctcgatttagtgtcacacgaagggaaagggggggtcgtcaggaggcagcgctctcgggacgtctccaccatggccgtgggcgtctgctattcctcaccctcctcactcagggcacagagtcctgggcccagtctgccctgactcagcctgcctccgtgtctgggtctcctggacagtcgatcaccatctcctgcactggaaccaacagtgacgttgatttttatatctctgtctcctggtaccaacaacacccaggcaaagcccccaaactcatcatttatgatgtcactgctcggccctcaggggtttctcatcgcttttctggctccaagtctggcaccacggcctccctgaccatctcggggctccaggctgaggacgaggctgcttattactgcagctcatatacaaggagcaccactctcgtggtattggtggagggaccaagctgaccgtcctaggtcagcccaaggctgccccctcggt

SEQ ID NO: 561682 - DNA, 516 bp, Homo sapiens
  misc_feature: HIJSMM301B79IM.7.34.D01.1.454.light.4.raw
  modified_base (364)..(364): a, c, t, g, unknown or other
cgtgtctctacacgaccggtgctcgatttagatcgtctgtgttgggtttggggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaacggcccccaaactcttgatttatgatgtctctaatccggccctccggcgtttctattcgcttctctggctccaagtctggcaacncggcctccctgaccatctctggactccagactgaggacgaggctgattattactgctgctcatatacgaggggacagcattatttgggtgtttcggcggagggaccaagctgaccgtcctgcgtcagcccaaggctcgccccctcggtcact

SEQ ID NO: 561683 - DNA, 499 bp, Homo sapiens
  misc_feature: HIJSMM301AK99Y.19.85.H08.1.454.light.4.raw
tactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctgggtcagccaggctgccctcggt

SEQ ID NO: 561684 - DNA, 485 bp, Homo sapiens; identical to SEQ ID NO: 535880
  misc_feature: HIJSMM301AVPYI.7.75.G09.1.454.light.4.raw

SEQ ID NO: 561685 - DNA, 485 bp, Homo sapiens; identical to SEQ ID NO: 535501
  misc_feature: HIJSMM301AKLVM.3.10.A10.1.454.light.4.raw

SEQ ID NO: 561686 - DNA, 497 bp, Homo sapiens; identical to SEQ ID NO: 535286
  misc_feature: HIJSMM301BDCF0.18.59.F04.1.454.light.4.raw

SEQ ID NO: 561687 - DNA, 493 bp, Homo sapiens; identical to SEQ ID NO: 535047
  misc_feature: HIJSMM301ANT2S.16.53.E09.1.454.light.4.raw

SEQ ID NO: 561688 - DNA, 416 bp, Homo sapiens; identical to SEQ ID NO: 535308
  misc_feature: HIJSMM301AFRED.16.46.E02.1.454.light.4.raw

SEQ ID NO: 561689 - DNA, 482 bp, Homo sapiens; identical to SEQ ID NO: 535352
  misc_feature: HIJSMM301BFG89.16.81.H04.1.454.light.4.raw

SEQ ID NO: 561690 - DNA, 502 bp, Homo sapiens; identical to SEQ ID NO: 553118
  misc_feature: HIJSMM301A9I3E.10.9.A09.1.454.light.4.raw

SEQ ID NO: 561691 - DNA, 503 bp, Homo sapiens
  misc_feature: HIJSMM301DS0LF.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattacagtcatcagagtactactttacctcaagtgatcaccttcggccaagggacacgactggagattaaacg

SEQ ID NO: 561692 - DNA, 444 bp, Homo sapiens; identical to SEQ ID NO: 535594
  misc_feature: HIJSMM301CDKD9.9.9.A09.1.454.light.4.raw

SEQ ID NO: 561693 - DNA, 498 bp, Homo sapiens; identical to SEQ ID NO: 535295
  misc_feature: HIJSMM301CLJON.15.25.C03.1.454.light.4.raw

SEQ ID NO: 561694 - DNA, 502 bp, Homo sapiens
  misc_feature: HIJSMM301CSFZY.14.57.F02.1.454.light.4.raw
cgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagatttgcagtttattactgtcagcagcggggcaattggccgctcactttcggcggggggaccgaaggtggagttcaaacgaactgtggctgcaccatctgtcttcatcttcccg

SEQ ID NO: 561695 - DNA, 487 bp, Homo sapiens
  misc_feature: HIJSMM301D3VS5.11.28.C06.1.454.light.4.raw
cgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggtttcagcagaggccaggccaatctccaaggcgcctaatttataaggtttctaggcgggactctggggtcccagacagattcagcggcagtgggtcaggcgctgatttcacactgagaatcagcagggtggaggctgaagatgtcggggtttattactgcatgcagggtacagtgtggccttgctcgcattcggcggagggaccaaggtggagatcaaacgaa

SEQ ID NO: 561696 - DNA, 487 bp, Homo sapiens
  misc_feature: HIJSMM301CG5OQ.48.10.A10.1.454.light.4.raw
agtatacatacacgaccggtgctcgatttagcgtcgatctcagggggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggccgggtatcaggagaaaccgggcaaagcccctgccctcctcatctataagtcctcaactttagagagtggggtcccatcaagattcagcggcagtggatctggaacagaattcactctcaccatcagcggcctgcagtctgatgatttgcaacttatttctgccaacagtatcatacttattctcggaccttcggccaagggaccagggtggaaatcaaacgaactagtggctgcaccatctgtcttcta

SEQ ID NO: 561697 - DNA, 497 bp, Homo sapiens; identical to SEQ ID NO: 536376
  misc_feature: HIJSMM301A36OE.22.9.A09.1.454.light.4.raw

SEQ ID NO: 561698 - DNA, 496 bp, Homo sapiens
  misc_feature: HIJSMM301DY7GF.15.26.C04.1.454.light.4.raw
tctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcagaaaccagggaaagcccctaacctcctaatctatgatgcctccagtttggagagtggggtcccatctaggttcagcggcagtggatttgggacagaattcactctcaccatccgcagcctgcagcctgaagattttgcaacttattactgccaacagtataatagcaattctccgtggacgttcggccaagggaccagggtggatatcaaacgaaactgtggctgcaccatctgtcttcatt

SEQ ID NO: 561699 - DNA, 454 bp, Homo sapiens; identical to SEQ ID NO: 535005
  misc_feature: HIJSMM301EXL8S.19.86.H09.1.454.light.4.raw

SEQ ID NO: 561700 - DNA, 511 bp, Homo sapiens; identical to SEQ ID NO: 557789
  misc_feature: HIJSMM301B2SKQ.53.71.G05.1.454.light.4.raw

SEQ ID NO: 561701 - DNA, 518 bp, Homo sapiens; identical to SEQ ID NO: 539372
  misc_feature: HIJSMM301CXP3Y.7.86.H09.1.454.light.4.raw

SEQ ID NO: 561702 - DNA, 507 bp, Homo sapiens
  misc_feature: HIJSMM301A6C1P.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaagctgaccgtcctaggtcagcccaaggctgccccccg

SEQ ID NO: 561703 - DNA, 493 bp, Homo sapiens; identical to SEQ ID NO: 535047
  misc_feature: HIJSMM301ALS25.16.53.E09.1.454.light.4.raw

SEQ ID NO: 561704 - DNA, 508 bp, Homo sapiens; identical to SEQ ID NO: 541908
  misc_feature: HIJSMM301D5C2Q.47.85.H08.1.454.light.4.raw

SEQ ID NO: 561705 - DNA, 510 bp, Homo sapiens
  misc_feature: HIJSMM301A9V54.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgtcggtccacgggaccgaccacgtagaaatagagacgaactacgtggctgcaccactctgtcttctatcttcccgt

SEQ ID NO: 561706 - DNA, 497 bp, Homo sapiens; identical to SEQ ID NO: 539058
  misc_feature: HIJSMM301C1CO2.12.87.H10.1.454.light.4.raw

SEQ ID NO: 561707 - DNA, 497 bp, Homo sapiens; identical to SEQ ID NO: 536376
  misc_feature: HIJSMM301CLQQM.22.9.A09.1.454.light.4.raw

SEQ ID NO: 561708 - DNA, 492 bp, Homo sapiens
  misc_feature: HIJSMM301AN9M7.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcatgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggcggagggaccagggtggagatcaaacgaactgtggctgcaccatctgtcttcta

SEQ ID NO: 561709 - DNA, 444 bp, Homo sapiens; identical to SEQ ID NO: 535042
  misc_feature: HIJSMM301D6WBL.10.76.G10.1.454.light.4.raw

SEQ ID NO: 561710 - DNA, 495 bp, Homo sapiens
  misc_feature: HIJSMM301ESTIC.21.81.H04.1.454.light.4.raw
tcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacgaggctgattattactgcaggtcatatacaatcagcaacacttatgtcttcgggactgggaccaagatcaccgtcctaggtcagcccaaggccaacccc

SEQ ID NO: 561711 - DNA, 508 bp, Homo sapiens; identical to SEQ ID NO: 535649
  misc_feature: HIJSMM301DXYIT.47.55.E11.1.454.light.4.raw

SEQ ID NO: 561712 - DNA, 481 bp, Homo sapiens
  misc_feature: HIJSMM301AOG8L.11.11.A11.1.454.light.4.raw
cgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctcctaaactgctcatctcctgggcatctacccgggcacccggagtccctgaccgattcagtggcagcgggtctgggacagacttcactctcaccatcagcaacctgcaggctgaagatgtggcagtttattactgtcagcagtattgtgaagctccgctcactttcggcggagggaccgcgggtggagatcagtacgaactggtggctgcaccatctgtctt

SEQ ID NO: 561713 - DNA, 502 bp, Homo sapiens
  misc_feature: HIJSMM301CLW0U.19.78.H01.1.454.light.4.raw
tactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactggaccaaggtcaccgtcctaggtcagcccaaggccaacccactgtca

SEQ ID NO: 561714 - DNA, 484 bp, Homo sapiens; identical to SEQ ID NO: 536162
  misc_feature: HIJSMM301BWUX8.13.59.F04.1.454.light.4.raw

SEQ ID NO: 561715 - DNA, 498 bp, Homo sapiens
  misc_feature: HIJSMM301DR2CA.48.61.F06.1.454.light.4.raw
agtatacatacacgaccggtgctcgatttagctacgctctaagggaaagggggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcaaggttcagtggcagtggatctgggacagatttcaccctcaccatcaatagcctggaagctgaagatgctgcaacctattactgtcatcagacttttagtttacgtcggaccttcggccaagggacacgactggagattaaacgaactgtgctgcaccatctgtcttcatcttcccg

SEQ ID NO: 561716 - DNA, 487 bp, Homo sapiens; identical to SEQ ID NO: 536536
  misc_feature: HIJSMM301C8ZAO.26.45.E01.1.454.light.4.raw

SEQ ID NO: 561717 - DNA, 457 bp, Homo sapiens; identical to SEQ ID NO: 541372
  misc_feature: HIJSMM301CZQ9F.41.57.F02.1.454.light.4.raw

SEQ ID NO: 561718 - DNA, 484 bp, Homo sapiens
  misc_feature: HIJSMM301DDAPV.48.35.D02.1.454.light.4.raw
agtatacatacacgaccggtgctcgatttagcacacgatagttgggtttgggggctgtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaagg

SEQ ID NO: 561719 - DNA, 498 bp, Homo sapiens; identical to SEQ ID NO: 543188
  misc_feature: HIJSMM301BBRIW.10.65.F10.1.454.light.4.raw

SEQ ID NO: 561720 - DNA, 517 bp, Homo sapiens; identical to SEQ ID NO: 537838
  misc_feature: HIJSMM301B0N33.7.86.H09.1.454.light.4.raw

SEQ ID NO: 561721 - DNA, 499 bp, Homo sapiens
  misc_feature: HIJSMM301AR7LA.48.33.C11.1.454.light.4.raw
agtatacatacacgaccggtgctcgatttagagtgagctcgttgggtttgggggagctacaacaggcaggcaggggcagcaagatggtgttgcagacccaggtcttcatttctctgttgctctggatctctggtgcctacggggacgtcgtgatgacccagtctccagactccctggcagtgtctctgggcgggagggccaccatcaactgcaagtccagccagagtattttatacagctcctacaataagagcgacttagcttggtaccagcagaaaccaggacagcctcctaagttgctcatttactgggcatctaaccggcaatccggggtccctgaccgattcagtggcagcgggtctgggacacatttcgctttcaccatcagcagcctgcaggctgaggatgtggcagtttattactgtcagcaatattatactactccgtggactttcggccaaggaccaaggtggaaatcagacgaactgtggctgcacca

SEQ ID NO: 561722 - DNA, 481 bp, Homo sapiens
  misc_feature: HIJSMM301AFPIG.21.25.C03.1.454.light.4.raw
tcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggttttggtctgttcggcggcgggacc

SEQ ID NO: 561723 - DNA, 506 bp, Homo sapiens; identical to SEQ ID NO: 542696
  misc_feature: HIJSMM301CC7TO.7.71.G05.1.454.light.4.raw

SEQ ID NO: 561724 - DNA, 506 bp, Homo sapiens
  misc_feature: HIJSMM301EHFCK.9.12.B01.1.454.light.4.raw
  modified_base (429)..(429): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttcncgggcgttcggtccaagggaccaacggtggaaatacaaacgaactagtggctgcaccatctgtcttcatcttccccg

SEQ ID NO: 561725 - DNA, 489 bp, Homo sapiens; identical to SEQ ID NO: 535139
  misc_feature: HIJSMM301EL0LR.14.55.E11.1.454.light.4.raw

SEQ ID NO: 561726 - DNA, 517 bp, Homo sapiens
  misc_feature: HIJSMM301CA594.10.38.D05.1.454.light.4.raw
  modified_base (473)..(473): a, c, t, g, unknown or other
catagtagtgcacgaccggtgctcgatttagtatctgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccacccaggcaaagcccccaaactccttgtttttgaggtcagtaagcggccctcaggagtccctgatcggttctctgcctccaagtctggcaacacggcctccctgaccgtctctgggctccaggctgaggatgaggctgattactactgcagcgcatattcaggccccaacagggtgtttggcggcgggactaaggtgaccgtccngggtcagcccaaggctgccccctcggtcactctgttcccaccct

SEQ ID NO: 561727 - DNA, 502 bp, Homo sapiens; identical to SEQ ID NO: 536604
  misc_feature: HIJSMM301D9UP3.27.78.H01.1.454.light.4.raw

SEQ ID NO: 561728 - DNA, 511 bp, Homo sapiens; identical to SEQ ID NO: 542853
  misc_feature: HIJSMM301CELJJ.17.33.C11.1.454.light.4.raw

SEQ ID NO: 561729 - DNA, 476 bp, Homo sapiens
  misc_feature: HIJSMM301BIRKU.48.29.C07.1.454.light.4.raw
agtatacatacacgaccggtgctcgatttagagtgctacgaagggaaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtgctaatacctatgtctcctggtaccaacaacacgcaggcaaagcccccaaactcatgatttatgatgtcactaagcggccctcaggggtccctgctcgcttctctggctccaagtctggcaacacggcctccctgaccatctctgggctccaggctgaagatgaggctgattatttctgctgctcatatgcagccaactattatgtcttcggaactgagaccaaggtcaccgtcct

SEQ ID NO: 561730 - DNA, 499 bp, Homo sapiens; identical to SEQ ID NO: 545732
  misc_feature: HIJSMM301A3AT2.3.33.C11.1.454.light.4.raw

SEQ ID NO: 561731 - DNA, 493 bp, Homo sapiens; identical to SEQ ID NO: 538304
  misc_feature: HIJSMM301BVRNC.26.72.G06.1.454.light.4.raw

SEQ ID NO: 561732 - DNA, 493 bp, Homo sapiens; identical to SEQ ID NO: 540127
  misc_feature: HIJSMM301ENEJN.10.17.B06.1.454.light.4.raw

SEQ ID NO: 561733 - DNA, 448 bp, Homo sapiens; identical to SEQ ID NO: 538166
  misc_feature: HIJSMM301DG6G9.18.9.A09.1.454.light.4.raw

SEQ ID NO: 561734 - DNA, 484 bp, Homo sapiens; identical to SEQ ID NO: 535400
  misc_feature: HIJSMM301ARCGM.46.26.C04.1.454.light.4.raw

SEQ ID NO: 561735 - DNA, 511 bp, Homo sapiens; identical to SEQ ID NO: 546062
  misc_feature: HIJSMM301EWHPK.5.58.F03.1.454.light.4.raw

SEQ ID NO: 561736 - DNA, 485 bp, Homo sapiens; identical to SEQ ID NO: 536799
  misc_feature: HIJSMM301DPNEZ.19.71.G05.1.454.light.4.raw

SEQ ID NO: 561737 - DNA, 480 bp, Homo sapiens; identical to SEQ ID NO: 535291
  misc_feature: HIJSMM301C2KRW.22.59.F04.1.454.light.4.raw

SEQ ID NO: 561738 - DNA, 485 bp, Homo sapiens; identical to SEQ ID NO: 535606
  misc_feature: HIJSMM301CYL4Z.47.46.E02.1.454.light.4.raw

SEQ ID NO: 561739 - DNA, 490 bp, Homo sapiens; identical to SEQ ID NO: 535936
  misc_feature: HIJSMM301AOO7K.16.68.G02.1.454.light.4.raw

SEQ ID NO: 561740 - DNA, 504 bp, Homo sapiens; identical to SEQ ID NO: 539690
  misc_feature: HIJSMM301ASJVZ.47.65.F10.1.454.light.4.raw

SEQ ID NO: 561741 - DNA, 479 bp, Homo sapiens
  misc_feature: HIJSMM301B2OEN.8.53.E09.1.454.light.4.raw
ctcgcgtgtccacgaccggtgctcgatttagagagagtgtgttgggtttggggggctctgcttcagctgtgggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcgcgggacc

SEQ ID NO: 561742 - DNA, 506 bp, Homo sapiens
  misc_feature: HIJSMM301A3F6L.12.53.E09.1.454.light.4.raw
atacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccgaagctgaccgtcctgggtcagcccaaggctgccccctcggtcactctgttcccaccctcctctacgtcgtat

SEQ ID NO: 561743 - DNA, 455 bp, Homo sapiens
  misc_feature: HIJSMM301BO7KS.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttccccgccctcctccacgagagta

SEQ ID NO: 561744 - DNA, 489 bp, Homo sapiens; identical to SEQ ID NO: 536013
  misc_feature: HIJSMM301BRFJ7.26.23.C01.1.454.light.4.raw

SEQ ID NO: 561745 - DNA, 495 bp, Homo sapiens
  misc_feature: HIJSMM301DHOVR.52.53.E09.1.454.light.4.raw
cgcagtacgacacgaccggtgctcgatttagagagagtgtgttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctcctcctcagggacaacagtcacgttgatcatcagtggagtccgagcagaggacgaggctgactattactgtcaatcaacagacagtagtggtacttatgtgcagttcggcggagggaccaagctgaccgtcctaggtcagcccaaggctgccccctcggt

SEQ ID NO: 561746 - DNA, 485 bp, Homo sapiens; identical to SEQ ID NO: 541014
  misc_feature: HIJSMM301A8GI9.7.85.H08.1.454.light.4.raw

SEQ ID NO: 561747 - DNA, 505 bp, Homo sapiens; identical to SEQ ID NO: 553744
  misc_feature: HIJSMM301D6PR7.8.33.C11.1.454.light.4.raw

SEQ ID NO: 561748 - DNA, 506 bp, Homo sapiens; identical to SEQ ID NO: 539926
  misc_feature: HIJSMM301D0JFG.5.24.C02.1.454.light.4.raw

SEQ ID NO: 561749 - DNA, 494 bp, Homo sapiens
  misc_feature: HIJSMM301BAE7K.43.61.F06.1.454.light.4.raw
tgtgagtagtcacgaccggtgctcgatttagctacgctctaagggaaaggggagagctctggagaagagctgctcagttaggacccagagggaaccatggaaaccccagcgcagcttctcttcctcctgctactctggctcccagatgccaccggagcaattgtgttgacgcagtctccaggcaccctgtctttgtctccaggagaaacagccaccctctcctgccgggccagtcagagtgttagagaagactacttagcctggtaccagcaaaaacctggccaggctcccaggctcctcatcaatggtgcatccagtagggccactggcatcccagacaggttcagtggcagtgggtctgcgacagacttcactctcattatcagcagactggacgcctgaggtactttgcagtgttatttctgtacaacaatagtggtagctcaccgtactacgttttggccgacggggaccaagctaagaatacaaacgaa

SEQ ID NO: 561750 - DNA, 482 bp, Homo sapiens
  misc_feature: HIJSMM301ECQE3.40.59.F04.1.454.light.4.raw
tctagcgactcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcgggagggaccaagctgaccgtctaacgtcacgaccccg

SEQ ID NO: 561751 - DNA, 506 bp, Homo sapiens
  misc_feature: HIJSMM301DA5JY.21.87.H10.1.454.light.4.raw
tcgtcgctcgcacgaccggtgctcgatttagcagtactgcgttgggtttgggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacgttttaaccttgtctcctggtatcaacaacaccaggacaaagccccaaaactcttaatttctggcgtcaatcagcgaccctcacatgtttccagtcgattctctgcatccaagtctggcaacacggcctttctgacaatctctcaactccaggctgaagacgaggctatttattactgctcctcatacgcaggtggcacatttttcctggtttttggcggcgggacccagatgactgtcctcagtcagcccaaggctgccccctcggt

SEQ ID NO: 561752 - DNA, 491 bp, Homo sapiens
  misc_feature: HIJSMM301CA2JL.27.78.H01.1.454.light.4.raw
  modified_base (431)..(431): a, c, t, g, unknown or other
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttactcaagtnatcacttcggccaagggacacgactgagattaaacgaactgtggctgcaccatctgtctt

SEQ ID NO: 561753 - DNA, 513 bp, Homo sapiens
  misc_feature: HIJSMM301APG7O.5.58.F03.1.454.light.4.raw
atcagacacgcacgaccggtgctcgatttagtctgatcgagaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcacacttttatgtttcgggactgggaccaaggtcaccgtcctaggtcagcccaaggccaaccccactgtcactctcg

SEQ ID NO: 561754 - DNA, 496 bp, Homo sapiens
  misc_feature: HIJSMM301CGOQ2.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcggccaaggaccaaggtggaaatcaaacgaactgtggctgcacca

SEQ ID NO: 561755 - DNA, 498 bp, Homo sapiens; identical to SEQ ID NO: 556912
  misc_feature: HIJSMM301BLG31.16.68.G02.1.454.light.4.raw

SEQ ID NO: 561756 - DNA, 491 bp, Homo sapiens; identical to SEQ ID NO: 538021
  misc_feature: HIJSMM301BNCFW.3.72.G06.1.454.light.4.raw

SEQ ID NO: 561757 - DNA, 441 bp, Homo sapiens; identical to SEQ ID NO: 546257
  misc_feature: HIJSMM301CF2EU.41.9.A09.1.454.light.4.raw

SEQ ID NO: 561758 - DNA, 477 bp, Homo sapiens
  misc_feature: HIJSMM301BNW4K.17.29.C07.1.454.light.4.raw
cgtagactagcacgaccggtgctcgatttagagtgctacgaagggaaaggggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgcatctcatatacaaccaacagcactctcgactggtattcggcggagggaccaagctgaccgtcctaggtcagcccaaggctgccccctcggtcactctgttcccgccctcctcctagtctacg

SEQ ID NO: 561759 - DNA, 509 bp, Homo sapiens; identical to SEQ ID NO: 553073
  misc_feature: HIJSMM301AY6PN.16.1.A01.1.454.light.4.raw

SEQ ID NO: 561760 - DNA, 505 bp, Homo sapiens
  misc_feature: HIJSMM301DZ1SH.47.83.H06.1.454.light.4.raw
agctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatactcccccagctggtaccagcagaccccgggccagactccacgcacgctcatctacaacacagacactcgctcttctggggtccctgatcgcttctctggttccatccttgggaacaagctgccctcaccatcgcggggcccaggcagatgatgagtgtgattattactgtgtgctctatatgggcagtggcgtttgggtgttcggcggagggaccaagctgaccgttcg

SEQ ID NO: 561761 - DNA, 478 bp, Homo sapiens; identical to SEQ ID NO: 552745
  misc_feature: HIJSMM301D4R2V.13.76.G10.1.454.light.4.raw

SEQ ID NO: 561762 - DNA, 517 bp, Homo sapiens; identical to SEQ ID NO: 543501
  misc_feature: HIJSMM301DIYWT.47.53.E09.1.454.light.4.raw

SEQ ID NO: 561763 - DNA, 454 bp, Homo sapiens; identical to SEQ ID NO: 535005
  misc_feature: HIJSMM301AHUL5.19.86.H09.1.454.light.4.raw

SEQ ID NO: 561764 - DNA, 488 bp, Homo sapiens; identical to SEQ ID NO: 535990
  misc_feature: HIJSMM301B48GE.11.28.C06.1.454.light.4.raw

SEQ ID NO: 561765 - DNA, 489 bp, Homo sapiens; identical to SEQ ID NO: 558034
  misc_feature: HIJSMM301EDG5H.8.12.B01.1.454.light.4.raw

SEQ ID NO: 561766 - DNA, 485 bp, Homo sapiens
  misc_feature: HIJSMM301BK889.52.34.D01.1.454.light.4.raw
  modified_base (454)..(454): a, c, t, g, unknown or other
cgcagtacgacacgaccggtgctcgatttagatcgtctgtgttgggtttggggagtctcagtcaggacacagcatggacatgagggtccccgctcagctcctggggctcctgctactctggctccgaggtgccagatgtgacacccagatgacccagtctccatcctccctgtctgcatctgtaggagacagagtcaccatcacgtgccgggcaagtcagagcattggcaggtatttaaattggtatcaacagaaaccagggaaagcccctaggctcctgatctatgctgcatcccgtttgcaaagtggggtcccgtcaaggttcagtggccgtggatctgggacagatttcactctcaccatcagcagtctccaacctgaagattttgcaatttactactgtcaacagatgacaatacccctcagactttcggcctggaccagagtggatatnaaacgaactgtggctgcaccatctgtcttct

SEQ ID NO: 561767 - DNA, 500 bp, Homo sapiens; identical to SEQ ID NO: 540219
  misc_feature: HIJSMM301A95X9.43.34.D01.1.454.light.4.raw

SEQ ID NO: 561768 - DNA, 504 bp, Homo sapiens
  misc_feature: HIJSMM301C81G5.22.5.A05.1.454.light.4.raw
  modified_base (482)..(482): a, c, t, g, unknown or other
acatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaagagccaccctctcctgcagggccagtcagagtgttaactactacttagcctggtaccaacagaaacctggccaggctcccaggctcctcatctatgatgcatcttacagggccactggcatcccagccaggttcagtggcagtgggtctgggacagacttcactctcaccatcagcagcctagagcctgaagattttgcagtttattactgtcagcagcgtagcaactccctcacgttcggtcggagggaccgaaggtaggaggatcaaacgaaactagtggctgcaccanctgtcttctatcttcccgtccc

SEQ ID NO: 561769 - DNA, 444 bp, Homo sapiens; identical to SEQ ID NO: 535027
  misc_feature: HIJSMM301AYUJP.8.73.G07.1.454.light.4.raw

SEQ ID NO: 561770 - DNA, 445 bp, Homo sapiens; identical to SEQ ID NO: 555301
  misc_feature: HIJSMM301CEGVN.5.9.A09.1.454.light.4.raw

SEQ ID NO: 561771 - DNA, 485 bp, Homo sapiens; identical to SEQ ID NO: 536576
  misc_feature: HIJSMM301BUH0H.46.35.D02.1.454.light.4.raw

SEQ ID NO: 561772 - DNA, 454 bp, Homo sapiens; identical to SEQ ID NO: 534964
  misc_feature: HIJSMM301EZGZB.19.86.H09.1.454.light.4.raw

SEQ ID NO: 561773 - DNA, 508 bp, Homo sapiens; identical to SEQ ID NO: 541327
  misc_feature: HIJSMM301B8QRJ.47.85.H08.1.454.light.4.raw

SEQ ID NO: 561774 - DNA, 494 bp, Homo sapiens
  misc_feature: HIJSMM301B4TDX.52.33.C11.1.454.light.4.raw
cgcagtacgacacgaccggtgctcgatttagagtgagctcgttgggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgt

SEQ ID NO: 561775 - DNA, 456 bp, Homo sapiens
  misc_feature: HIJSMM301CBSI2.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcggggagcagtggtgtgatgtggtatcagaaagtcccaggaaccggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcgcaaggctgccccctcggtcactctgttcccaccctcctccacgagagta

SEQ ID NO: 561776 - DNA, 520 bp, Homo sapiens
  misc_feature: HIJSMM301E0N85.10.26.C04.1.454.light.4.raw
catagtagtgcacgaccggtgctcgattagtctagcgactttgggtttgggggctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtcccccgtggacgttcggccaagggaccaacggtgggcaatcaaccgaactgtggctgcaccatctgtcttcatcttcccgccca

SEQ ID NO: 561777 - DNA, 518 bp, Homo sapiens; identical to SEQ ID NO: 552467
  misc_feature: HIJSMM301DAU9U.9.2.A02.1.454.light.4.raw

SEQ ID NO: 561778 - DNA, 486 bp, Homo sapiens; identical to SEQ ID NO: 535385
  misc_feature: HIJSMM301EOP9A.19.71.G05.1.454.light.4.raw

SEQ ID NO: 561779 - DNA, 495 bp, Homo sapiens
  misc_feature: HIJSMM301DPMUK.16.86.H09.1.454.light.4.raw
tgtactactccacgaccggtgctcgatttagtgctatagacttgggtttgggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcggcggtgggaccaaagctgaccgtcctaggtcagcccaagg

SEQ ID NO: 561780 - DNA, 504 bp, Homo sapiens
  misc_feature: HIJSMM301CB4C5.8.55.E11.1.454.light.4.raw
ctcgcgtgtccacgaccggtgctcgatttagcactcgcacgttgggtttggggagctctgcttcagctgtgagcgcagaaggcaggactcgggacaatcgtcatcatgacctgctcccctctcctcctcacccttctcattcactgcacagggtcctgggcccagccagtgttgacgcaggcgccctcagtatctgcggccccgggacagagggtcaccatctcctgctccggaagcacctcaaatattggggacagttttgtatcgtggtatcagcaagtccccggaacagcccccaaactcctcatttatgaggataatgagcgacgttcaggaattcctgaccgtttctctggctccaagtctggcacgtcagccaccctgggcatcaccggactccagactgggacgaggccgactattactgcggagcatggatagcagcctgaacactgtggtcttcggcggagggaccaagctgaccgtccttagtcagcccaacgg

SEQ ID NO: 561781 - DNA, 502 bp, Homo sapiens
  misc_feature: HIJSMM301EDMIP.51.23.C01.1.454.light.4.raw
cgatcgtatacacgaccggtgctcgatttagtacacgtgattagggattggggaggaactgctcagttaggacccagagggaaccatggaagccccagctcagcttctcttcctcctgctactctggctcccagataccatcggggaaactgtgttgacacagtctccagccaccctgtctttgtctccaggggaaagagccaccctctcctgcagggccagtgagagtattgacatcttcttggcctggtaccaacagaaacctggccaggctccccgactcctcatttatgatgcatccaaaagggtcgttggcatcccagccaggttcagtggcagtgggtctgggacagaattcactctcaccatcaccagactagagcctgaagattttgcagtttattactgtcagcagcgtaacaactggctctctttcggcggagggaccaaggtggagatcaaacgaactgtggctgcaccatctgtcttcatcttcccgcat

SEQ ID NO: 561782 - DNA, 514 bp, Homo sapiens; identical to SEQ ID NO: 546238
  misc_feature: HIJSMM301CFYEN.47.85.H08.1.454.light.4.raw

SEQ ID NO: 561783 - DNA, 496 bp, Homo sapiens; identical to SEQ ID NO: 535109
  misc_feature: HIJSMM301BS38D.16.78.H01.1.454.light.4.raw

SEQ ID NO: 561784 - DNA, 485 bp, Homo sapiens; identical to SEQ ID NO: 540084
  misc_feature: HIJSMM301A4V3M.47.78.H01.1.454.light.4.raw
  modified_base (467)..(467): a, c, t, g, unknown or other

SEQ ID NO: 561785 - DNA, 486 bp, Homo sapiens; identical to SEQ ID NO: 535043
  misc_feature: HIJSMM301DHOJ6.46.35.D02.1.454.light.4.raw

SEQ ID NO: 561786 - DNA, 484 bp, Homo sapiens; identical to SEQ ID NO: 535240
  misc_feature: HIJSMM301ADXO7.47.60.F05.1.454.light.4.raw

SEQ ID NO: 561787 - DNA, 489 bp, Homo sapiens; identical to SEQ ID NO: 535139
  misc_feature: HIJSMM301AT5X0.14.55.E11.1.454.light.4.raw

SEQ ID NO: 561788 - DNA, 521 bp, Homo sapiens; identical to SEQ ID NO: 539470
  misc_feature: HIJSMM301C9JM6.27.23.C01.1.454.light.4.raw

SEQ ID NO: 561789 - DNA, 507 bp, Homo sapiens
  misc_feature: HIJSMM301BN8NS.47.83.H06.1.454.light.4.raw
agctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggtttgggacaggagtggattctcagactgtggtgacccaggagccatcgttctcagtgtcccgtggagggacagtcacactcacttgtggcttgagctctggctcagtctccactacatactcccccagctggtaccagcagaccccgggccagactccacgcacgctcatctacaacacagacactcgctcttctggggtccctgatcgcttctctggttccatccttgggaacaaagctgccctcaccatcgcgggggccccaggcagatgatgagtgtgattattactgtgtgctctatatgggcagtggcgtttgggtgttcggcggagggaccaagctgaccgttcg

SEQ ID NO: 561790 - DNA, 492 bp, Homo sapiens; identical to SEQ ID NO: 534967
  misc_feature: HIJSMM301EJ8CN.47.64.F09.1.454.light.4.raw

SEQ ID NO: 561791 - DNA, 493 bp, Homo sapiens; identical to SEQ ID NO: 536769
  misc_feature: HIJSMM301BZLDD.19.83.H06.1.454.light.4.raw

SEQ ID NO: 561792 - DNA, 488 bp, Homo sapiens; identical to SEQ ID NO: 537149
  misc_feature: HIJSMM301B1FNX.51.42.D09.1.454.light.4.raw

SEQ ID NO: 561793 - DNA, 494 bp, Homo sapiens; identical to SEQ ID NO: 534994
  misc_feature: HIJSMM301B2XDR.27.78.H01.1.454.light.4.raw

SEQ ID NO: 561794 - DNA, 510 bp, Homo sapiens
  misc_feature: HIJSMM301BVG8J.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccgaagggaccgaaggtaggaaagtacaaacggaactagtggctgcaccatctgtcttctatcttccccg

SEQ ID NO: 561795 - DNA, 511 bp, Homo sapiens
  misc_feature: HIJSMM301AYK1H.11.1.A01.1.454.light.4.raw
cgagagataccacgaccggtgctcgatttagacgtctcatcaggggaggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggccctgctgctgctgggtctggccatggtcgcccatggcctgctgcgcccaatggttgcaccgcaaagcggggacccagaccctggagcctcagttggaagcagccgatccagcctgcggagccgtgtggggcaggtcagcccaaggccaacccccactcgtcact

SEQ ID NO: 561796 - DNA, 492 bp, Homo sapiens; identical to SEQ ID NO: 556964
  misc_feature: HIJSMM301C266Q.26.78.H01.1.454.light.4.raw

SEQ ID NO: 561797 - DNA, 494 bp, Homo sapiens; identical to SEQ ID NO: 534994
  misc_feature: HIJSMM301BJDOD.27.78.H01.1.454.light.4.raw

SEQ ID NO: 561798 - DNA, 461 bp, Homo sapiens
  misc_feature: HIJSMM301DZUVK.4.39.D06.1.454.light.4.raw
agcactgtagcacgaccggtgctcgatttagtgacatctcgcagttctttggggcttctcctgctgctctggctcccaggtgccgagggtgacatccagctgacccagtcgccctccaccgtgtctgcatccgtaggagacagagtcaccatcacctgtcgggccagtcagaatatttacagttggttggcctggtatcaccagagaccaggagaagccccaaacctcctcatttatgatgcctccactttgaatggaggggtcccaccaacattcagcggcagtggatctgggacagagttcactctaaccatcagcagcctgcagcctgatgatcttggaacttatttctgccagcaatataatagttattggacgtttcggccaggggaccaaggtcgaaatgagacgaactgtggctgcaccatctgtcttcatcttcccgccatctgactacagtg

SEQ ID NO: 561799 - DNA, 508 bp, Homo sapiens
  misc_feature: HIJSMM301A73G8.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccctcggtcactttcgttcctcccgtccctccgtacgtgtcgtctctcgtc

SEQ ID NO: 561800 - DNA, 514 bp, Homo sapiens
  misc_feature: HIJSMM301BWCKQ.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggcctgccccctcggtcactctgttcccaccctcct

SEQ ID NO: 561801 - DNA, 486 bp, Homo sapiens; identical to SEQ ID NO: 535458
  misc_feature: HIJSMM301D8FES.7.75.G09.1.454.light.4.raw

SEQ ID NO: 561802 - DNA, 509 bp, Homo sapiens; identical to SEQ ID NO: 543772
  misc_feature: HIJSMM301A1ADA.2.21.B10.1.454.light.4.raw

SEQ ID NO: 561803 - DNA, 494 bp, Homo sapiens; identical to SEQ ID NO: 534992
  misc_feature: HIJSMM301A97JA.9.1.A01.1.454.light.4.raw

SEQ ID NO: 561804 - DNA, 507 bp, Homo sapiens
  misc_feature: HIJSMM301BMOUB.9.12.B01.1.454.light.4.raw
  modified_base (476)..(476): a, c, t, g, unknown or other
  modified_base (490)..(490): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaaatccggggtccctgaccgattcagtggcagcgggtctgggacagatttcactctcaccatcagcagcctgcaggctgaagatgtggcagtttattactgtcaaacagttttctcgggcgttcggcaaggaccgaaggtggaaagtcaaacgaactagnggtctgcaccactntctcttcatcttccccg

SEQ ID NO: 561805 - DNA, 478 bp, Homo sapiens
  misc_feature: HIJSMM301CC9Z2.10.74.G08.1.454.light.4.raw
catagtagtgcacgaccggtgctcgatttagtagctctatcaggggaggaactgctcagttaggacccagacggaaccatggaagccccagcgcagcttctcttcctcctgctactctggctcccagataccactggagaaatagtgatgacgcagtctccagccaccctgtctgtgtctccaggggaaggagccaccctctcctgcagggccagtcagagtattagcagcaacttagcctggtaccagcagaaacctggccagtctcccaggctcctcctctatgatgcatccaccagggccactggtatcccagccaggttcagtggcagtgggtctgggacagagttcactctcaccatcagcagcctgcagtctgaggatattgcagtttattactgtcagcagtatactaactggcctctgacgttcggccaagggaccagggtggaaatcaaacgaactgtggctgcaccat

SEQ ID NO: 561806 - DNA, 507 bp, Homo sapiens
  misc_feature: HIJSMM301AI3B9.48.36.D03.1.454.light.4.raw
agtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgaccatctctgggctccaggctgaagatcaggctgattattactgctgttctattttctaagttccttttttgtcttcggaactgggaccgaggtcaccgtcctaggtcagcccaaggccaaccccactgtcta

SEQ ID NO: 561807 - DNA, 491 bp, Homo sapiens
  misc_feature: HIJSMM301DADYZ.47.70.G04.1.454.light.4.raw
agctcacgtacacgaccggtgctcgatttagtgtagtgtgaagggaaagggggagtcagtctcagtcaggacacagcatggacatgagggtccccgcccagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtaccccgtacacttttggccgaggggaccaaactggacatcaaacgaactgtggctgcaccatctgtctt

SEQ ID NO: 561808 - DNA, 514 bp, Homo sapiens
  misc_feature: HIJSMM301AD3BJ.49.38.D05.1.454.light.4.raw
agtcgagagacacgaccggtgctcgatttagtatctgatagttgggtttgggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgccaaaaagatatgcttattggtaccatcagaagtcaggccaggcccctgtactggtcatctatgaggacaccaaacgaccctccgggatccctacgagattctctggctccagtttagggacagtggccaccctgacagtcagtggggcccaggtggaggatgagggtgattactactgttactcaacagacattactactactcatagggtgttcggcggagggaccaagctgaccgtcctaggtcagcccaaggctgccccctccggtcactctcgttcccaccct

SEQ ID NO: 561809 - DNA, 484 bp, Homo sapiens
  misc_feature: HIJSMM301AY743.47.38.D05.1.454.light.4.raw
agctcacgtacacgaccggtgctcgatttagtatctgatagttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcagacacagattttacgctgaaaatcagtagggtggaggctgatgatgttggggtttattactgcatgcaagttctacaaacttcctacacttttggccaggggaccaagctggatatcaaacgaa

SEQ ID NO: 561810 - DNA, 491 bp, Homo sapiens
  misc_feature: HIJSMM301EJDGL.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgcagtctgaagattttgcagtttattactgtcagcagtatgatacctggcctccgtacacttttggccgggaaccaagctggaatcaagcgaactgtggctgcaccatctgtcttcatt

SEQ ID NO: 561811 - DNA, 490 bp, Homo sapiens; identical to SEQ ID NO: 535234
  misc_feature: HIJSMM301BD75X.17.21.B10.1.454.light.4.raw

SEQ ID NO: 561812 - DNA, 494 bp, Homo sapiens; identical to SEQ ID NO: 541035
  misc_feature: HIJSMM301AJJCD.26.12.B01.1.454.light.4.raw

SEQ ID NO: 561813 - DNA, 504 bp, Homo sapiens
  misc_feature: HIJSMM301DFW1V.52.55.E11.1.454.light.4.raw
cgcagtacgacacgaccggtgctcgatttagcactcgcacgttgggtttggggggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtattagcaactacttagcctggtaccaacagaaacctggccaggctcccaggctcctcatctatgatgcgtccaacagggccactggcatcccagccaggttcagtggcggtgggtctgggacagacttcactctcaccatcagcagcctagagcctgagattttgcagtttattactgtcagcagcgtagcaactggcctccgatcaccttcggccaagggacacgactggagattaaacgaactgtggctgcaccatctgtcttcatcttccccg

SEQ ID NO: 561814 - DNA, 493 bp, Homo sapiens; identical to SEQ ID NO: 535278
  misc_feature: HIJSMM301CIH89.51.81.H04.1.454.light.4.raw

SEQ ID NO: 561815 - DNA, 501 bp, Homo sapiens
  misc_feature: HIJSMM301A5CI8.14.5.A05.1.454.light.4.raw
cgtctagtaccacgaccggtgctcgatttagatagatagacaggggggaactgctcagttaggacccagagggaaccatggaagccccagctcagcttctcttcctcctgctactctggctcccagataccaccggagaaattgtgttgacacagtctccaggcaccctgtccttgtctccaggggaaagagccaccctctcctgcagggccagtcagagtgttgatacgtacttagcctggtaccaacagaaacctggccaggctcccaggctcctcatctatgatgcatccatcagggccactggcatcccagccaggttcagtggcagtgggtctgggacagacttcactctcaccatcagcagcctagagcctgaagtattttgctagtttattactgtcagcagcgtaccaactcggcctcctgcgctctactttcggcgggaggggaccgaaggtgggagatacaaacgaactgtggctgcaccatctgtcttct

SEQ ID NO: 561816 - DNA, 494 bp, Homo sapiens; identical to SEQ ID NO: 534992
  misc_feature: HIJSMM301EXY6S.9.1.A01.1.454.light.4.raw

SEQ ID NO: 561817 - DNA, 496 bp, Homo sapiens; identical to SEQ ID NO: 537925
  misc_feature: HIJSMM301DA571.22.14.B03.1.454.light.4.raw

SEQ ID NO: 561818 - DNA, 505 bp, Homo sapiens; identical to SEQ ID NO: 538054
  misc_feature: HIJSMM301B855L.8.55.E11.1.454.light.4.raw

SEQ ID NO: 561819 - DNA, 502 bp, Homo sapiens
  misc_feature: HIJSMM301C9WX7.51.28.C06.1.454.light.4.raw
cgatcgtatacacgaccggtgctcgatttagagctcacgtattgggtttggggggccgtcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggatccctgagcgattctctggctccaactctgggaacacagccactctgaccatcagcgggacgcaggctgtggatgaggctgacttttactgtcaggcgtgggacagcgacactgccgtggttcgggcgggggaccgaagcgtgaccgtcctccggtcagcccaacggctcgccccctccggtcactcc

SEQ ID NO: 561820 - DNA, 503 bp, Homo sapiens
  misc_feature: HIJSMM301A12FP.22.15.B04.1.454.light.4.raw
  modified_base (450)..(450): a, c, t, g, unknown or other
acatacgcgtcacgaccggtgctcgatttagacagtatatatccgcgggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacaacacccaggcaaagcccccaaactcatgatttatgaggtcactaagcggccctcaggggtccctgatcgcttctctggctccaagtctggcaacacggcctccctgaccgtctctgggctccaggctgaggatggaggctgattattactgcagctcatatggaggcagcgacatttggtgttcggnggaggaccaagctgaccgtcctaggtcagcccaaggctcgccccctcggtcta

SEQ ID NO: 561821 - DNA, 512 bp, Homo sapiens; identical to SEQ ID NO: 557140
  misc_feature: HIJSMM301C1TFC.48.34.D01.1.454.light.4.raw

SEQ ID NO: 561822 - DNA, 497 bp, Homo sapiens
  misc_feature: HIJSMM301EB0Y7.26.80.H03.1.454.light.4.raw
  modified_base (465)..(465): a, c, t, g, unknown or other
agactatactcacgaccggtgctcgatttagctgtgcgtcgaagggaaagggactgactaccacctgcaggtcagggccaaggttatggggtcccaggttcacctcctcagcttcctcctcctttggatctctgagccgacactcacgcagtctccagcattcatgtcagcgactctaggagacaaggtcaacttctcctccaaagccagccaagacattgatgatgatatgaactggcaccaacacaaaccaggagaagctgctatttccattactcaagaaactaatggtctcctacctggaatgccacctcgactcagtggcaacaaatatggaacagtttttaccctcacaactcatatcacagaatctgaggatgctgcattttacttcggtctacaacatgataatttccctccgtggacgttcggccaagggaccaaggagcaaatcaaacgaactgnggctgcaccatctgtcttcatcttcccgccat

SEQ ID NO: 561823 - DNA, 493 bp, Homo sapiens
  misc_feature: HIJSMM301CLE0K.16.73.G07.1.454.light.4.raw
tgtactactccacgaccggtgctcgatttagctctacgctcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcaacaatattataataatccatttaatttcggcggagggaccaaggtggagatcaaacgaactgtggctgcaccatctgtcttcatcttcccgcccta

SEQ ID NO: 561824 - DNA, 520 bp, Homo sapiens; identical to SEQ ID NO: 537173
  misc_feature: HIJSMM301A6VDT.27.23.C01.1.454.light.4.raw

SEQ ID NO: 561825 - DNA, 497 bp, Homo sapiens
  misc_feature: HIJSMM301A3HV0.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaagggaccgaaagtaggacgatcaagacgaactagtggcgtgcaccatctgtt

SEQ ID NO: 561826 - DNA, 495 bp, Homo sapiens; identical to SEQ ID NO: 535293
  misc_feature: HIJSMM301A1BJG.9.1.A01.1.454.light.4.raw

SEQ ID NO: 561827 - DNA, 494 bp, Homo sapiens; identical to SEQ ID NO: 559643
  misc_feature: HIJSMM301DJSRE.27.78.H01.1.454.light.4.raw

SEQ ID NO: 561828 - DNA, 495 bp, Homo sapiens
  misc_feature: HIJSMM301EV65E.4.24.C02.1.454.light.4.raw
agcactgtagcacgaccggtgctcgatttagtacagatcgttaggggaaagggggagtcagactcagtcaggacacagcatggacatgagggtccccgctcagctcctggggctcctgctgctctggctcccaggtgccaaatgtgacgtccagatgacccagtctccttccaccctgtctgcatctataggagacagagtcaccatcacttgccgggccagtcagagtattagtaactggttggcctggtatcagcagaaaccaggcaaagccccaaaactccttatctctgatgcctccactttgcacggtggggtcccaccaacgttcagcggcagtgggtctgggacagaattcactctcaccatcagcagcctgcaacctgatgatgttgcaacttattactgtacaacaatataacagttattggacgttcggccaagggaccgaaggtggaaatacagacgaactgtggctgcaccatctgtcttcta

SEQ ID NO: 561829 - DNA, 442 bp, Homo sapiens
  misc_feature: HIJSMM301EPJ4C.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtctaagtcagccaaggctgccccctcggtcactctgttcccgccctcctccgtgtctgat

SEQ ID NO: 561830 - DNA, 371 bp, Homo sapiens
  misc_feature: HIJSMM301AOWTV.18.60.F05.1.454.light.4.raw
tacgagtatgcacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagacctggagcctgaagattttgcagtgtattactgtcagcagtacggtagttcatctccgacgttcggccaagggaccaaggtggaatcaacgactgtggctgcaccatctgtcttcatcttcctgccatctgacatactcgta

SEQ ID NO: 561831 - DNA, 455 bp, Homo sapiens; identical to SEQ ID NO: 535447
  misc_feature: HIJSMM301BDJ9F.19.71.G05.1.454.light.4.raw

SEQ ID NO: 561832 - DNA, 486 bp, Homo sapiens; identical to SEQ ID NO: 535043
  misc_feature: HIJSMM301CNZ9S.46.35.D02.1.454.light.4.raw

SEQ ID NO: 561833 - DNA, 506 bp, Homo sapiens
  misc_feature: HIJSMM301DP0J5.9.71.G05.1.454.light.4.raw
tgatacgtctcacgaccggtgctcgatttagtgtcgtcgcaagagagagggggggggtcgacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcggagggaccaggctgaccgtcctgagtcagcccaaggctgtccccccg

SEQ ID NO: 561834 - DNA, 490 bp, Homo sapiens; identical to SEQ ID NO: 535064
  misc_feature: HIJSMM301D87TV.10.72.G06.1.454.light.4.raw

SEQ ID NO: 561835 - DNA, 469 bp, Homo sapiens
  misc_feature: HIJSMM301C1XKB.14.68.G02.1.454.light.4.raw
cgtctagtaccacgaccggtgctcgatttagtcgatagtgaagggaaagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacatcaggaaatatttaaattggtatcagcagaaaccagggaaagcccctaaactcctgatcttcgatgcatccaatttggaaacagggtcccatcaaggttcaggggaagtggatctgggacagatttagtttcaccatcagcagcctgcagcctgaagatattggacatattatgtcaacagtatgataattaactctcacttcgtcggacggacgaacggaggacgatacaacgaac

SEQ ID NO: 561836 - DNA, 477 bp, Homo sapiens; identical to SEQ ID NO: 561758
  misc_feature: HIJSMM301E1R4S.17.29.C07.1.454.light.4.raw

SEQ ID NO: 561837 - DNA, 498 bp, Homo sapiens
  misc_feature: HIJSMM301C09B8.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaaggagaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagaattaaacgaactagtggctgcaccatctgtctt

SEQ ID NO: 561838 - DNA, 486 bp, Homo sapiens
  misc_feature: HIJSMM301A7EZC.19.57.F02.1.454.light.4.raw
tactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgcaacttatttttgtcaacaggctaacactttcccctcactttcggcggagggaccaaggtggagatcaagcgaactgtgctgcaccat

SEQ ID NO: 561839 - DNA, 519 bp, Homo sapiens; identical to SEQ ID NO: 547780
  misc_feature: HIJSMM301DSOTK.5.27.C05.1.454.light.4.raw

SEQ ID NO: 561840 - DNA, 492 bp, Homo sapiens
  misc_feature: HIJSMM301DQDNH.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagcggcctgcagtctgaagattttgcagtttattactgtcagcagtataatgacttgggttttattctactttcggccctgggaccaaagtggtattcagacgaactgtggctgcaccatctgtcttc

SEQ ID NO: 561841 - DNA, 454 bp, Homo sapiens; identical to SEQ ID NO: 534964
  misc_feature: HIJSMM301EEEJG.19.86.H09.1.454.light.4.raw

SEQ ID NO: 561842 - DNA, 495 bp, Homo sapiens
  misc_feature: HIJSMM301ERJUN.49.25.C03.1.454.light.4.raw
agtcgagagacacgaccggtgctcgatttagtagtgtagatttgggtttggggaggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgggacagacttcactctcaccatcagcagcctagagcctgaagattttgcagtctattactgtcagcagcgttacaactggcctcccatgtacacttttggccaggggaccaagctggaaatcagacgaactgtggctgcaccatctgt

SEQ ID NO: 561843 - DNA, 481 bp, Homo sapiens; identical to SEQ ID NO: 535993
  misc_feature: HIJSMM301CSHT1.21.25.C03.1.454.light.4.raw

SEQ ID NO: 561844 - DNA, 485 bp, Homo sapiens; identical to SEQ ID NO: 536695
  misc_feature: HIJSMM301EB72I.10.1.A01.1.454.light.4.raw

SEQ ID NO: 561845 - DNA, 481 bp, Homo sapiens
  misc_feature: HIJSMM301B65US.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtccgctcactttcggcgagggaccaaggtgagatcaaacgaa

SEQ ID NO: 561846 - DNA, 510 bp, Homo sapiens
  misc_feature: HIJSMM301A420T.21.87.H10.1.454.light.4.raw
tcgtcgctcgcacgaccggtgctcgatttagcagtactgcgttgggtttggggggggtcgacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacgttttaaccttgtctcctggtatcaacaacaccaggacaaagccccaaaactcttaatttctggcgtcaatcagcgaccctcacatgtttccagtcgattctctgcatccaagtctggcaacacggccttttctgacaatctctcaactccaggctgaagacgaggctatttattactgctcctcatacgcaggtggcacatttttcttggtttttggcggcgggacccagatgactgtcctcagtcagcccaaggctcgccccctcggt

SEQ ID NO: 561847 - DNA, 473 bp, Homo sapiens; identical to SEQ ID NO: 558291
  misc_feature: HIJSMM301BG8XZ.52.59.F04.1.454.light.4.raw

SEQ ID NO: 561848 - DNA, 489 bp, Homo sapiens
  misc_feature: HIJSMM301CUMHL.22.65.F10.1.454.light.4.raw
  modified_base (365)..(365): a, c, t, g, unknown or other
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgnggtctgcaacctgaagatttcgcaacttactactgtcaacagacttacagtgccccccgatcaccttcggccaagggacacgactggagattaaacgaactgtggctgcaccatctgtcttcat

SEQ ID NO: 561849 - DNA, 485 bp, Homo sapiens; identical to SEQ ID NO: 535985
  misc_feature: HIJSMM301EFMHL.15.1.A01.1.454.light.4.raw

SEQ ID NO: 561850 - DNA, 470 bp, Homo sapiens
  misc_feature: HIJSMM301CXIY9.51.67.G01.1.454.light.4.raw
cgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattactgtcaacagtatgatagtctcccgctcactttcggcgggggaccgaaggtggagatcaagcgaactgtgg

SEQ ID NO: 561851 - DNA, 485 bp, Homo sapiens; identical to SEQ ID NO: 535363
  misc_feature: HIJSMM301D492H.17.26.C04.1.454.light.4.raw

SEQ ID NO: 561852 - DNA, 505 bp, Homo sapiens
  misc_feature: HIJSMM301CIWQY.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcgggagggaccaaggtggagatcaaacgaaactgtggctgcaccatct

SEQ ID NO: 561853 - DNA, 505 bp, Homo sapiens; identical to SEQ ID NO: 536254
  misc_feature: HIJSMM301CLAUA.7.71.G05.1.454.light.4.raw

SEQ ID NO: 561854 - DNA, 505 bp, Homo sapiens; identical to SEQ ID NO: 535987
  misc_feature: HIJSMM301AM001.18.37.D04.1.454.light.4.raw

SEQ ID NO: 561855 - DNA, 493 bp, Homo sapiens; identical to SEQ ID NO: 535770
  misc_feature: HIJSMM301C6RMX.51.71.G05.1.454.light.4.raw

SEQ ID NO: 561856 - DNA, 514 bp, Homo sapiens; identical to SEQ ID NO: 544242
  misc_feature: HIJSMM301EAQ2G.43.23.C01.1.454.light.4.raw

SEQ ID NO: 561857 - DNA, 496 bp, Homo sapiens; identical to SEQ ID NO: 535541
  misc_feature: HIJSMM301BSPHA.3.33.C11.1.454.light.4.raw

SEQ ID NO: 561858 - DNA, 497 bp, Homo sapiens; identical to SEQ ID NO: 535664
  misc_feature: HIJSMM301AI7RQ.22.14.B03.1.454.light.4.raw

SEQ ID NO: 561859 - DNA, 505 bp, Homo sapiens
  misc_feature: HIJSMM301DWGI7.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcattctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtctaggtcacgcccaaggcccaaccccactgtcta

SEQ ID NO: 561860 - DNA, 507 bp, Homo sapiens
  misc_feature: HIJSMM301ETF8Y.11.75.G09.1.454.light.4.raw
cgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccggttatggtatgctctggtatcaacaacgtccaggaatggcccccaaactcctcatctatgctgacaacaatcgaccttcaggggtccctgaccggttctctggctccaagtctggctcttccgcctccttggccatcactgggctcgaggctgacgatgaggctgattactactgtctgtcctatgacgacgacctacagactccggttttcggcggagggactaagctgaccgtcctaagtcagcccaaggctgccccctcggtcactctgttcccca

SEQ ID NO: 561861 - DNA, 515 bp, Homo sapiens
  misc_feature: HIJSMM301DKVO1.8.43.D10.1.454.light.4.raw
ctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttatagtacaaacaacagacactcctggacccctgcccggttctcaggctccctccttgggccaaagctgccctgacactgtcaggtgtgcagcctgaggacgaggctgagtattactgcctgctctattatggtgggccttgggtgttcggcggagggaccaagctgaccgtcctaggtcagcccaaggctgccccctcggtcactctgttcccaccctcctcgacacgcg

SEQ ID NO: 561862 - DNA, 471 bp, Homo sapiens; identical to SEQ ID NO: 537461
  misc_feature: HIJSMM301DU3QJ.7.81.H04.1.454.light.4.raw

SEQ ID NO: 561863 - DNA, 480 bp, Homo sapiens; identical to SEQ ID NO: 549459
  misc_feature: HIJSMM301C8KC1.21.25.C03.1.454.light.4.raw

SEQ ID NO: 561864 - DNA, 521 bp, Homo sapiens
  misc_feature: HIJSMM301CB6D8.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtggttcggcggagggaccaggctgaccgtcctaggtcagcccaaggctgccccctcggtcactctgttcccacct

SEQ ID NO: 561865 - DNA, 447 bp, Homo sapiens; identical to SEQ ID NO: 560488
  misc_feature: HIJSMM301CTA50.18.73.G07.1.454.light.4.raw

SEQ ID NO: 561866 - DNA, 455 bp, Homo sapiens; identical to SEQ ID NO: 552052
  misc_feature: HIJSMM301DN03U.19.86.H09.1.454.light.4.raw

SEQ ID NO: 561867 - DNA, 485 bp, Homo sapiens
  misc_feature: HIJSMM301ATC1M.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtccccgctcactttcggcggagggaccaaggtggagatcaaacgaa

SEQ ID NO: 561868 - DNA, 505 bp, Homo sapiens; identical to SEQ ID NO: 535503
  misc_feature: HIJSMM301AZXWD.8.28.C06.1.454.light.4.raw

SEQ ID NO: 561869 - DNA, 506 bp, Homo sapiens
  misc_feature: HIJSMM301CKNE6.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcggccaacgggaccgaaggtggaaatcaaacgaactagtggctgcaccatctgtcttcatcttccccg

SEQ ID NO: 561870 - DNA, 514 bp, Homo sapiens
  misc_feature: HIJSMM301AIHRK.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgccgacggaccgaaggtaggaaggtacaaacgaactacgtggcgtgcaccactctgtcttctatcttcccgtcccact

SEQ ID NO: 561871 - DNA, 503 bp, Homo sapiens
  misc_feature: HIJSMM301EKP7A.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctgggtcagcccaaggctgcccctcggtca

SEQ ID NO: 561872 - DNA, 518 bp, Homo sapiens
  misc_feature: HIJSMM301DEMMY.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagccgtgtggggcaggtcagcccaaggccaacccactgtcactctcg

SEQ ID NO: 561873 - DNA, 486 bp, Homo sapiens; identical to SEQ ID NO: 535043
  misc_feature: HIJSMM301CCS7Y.46.35.D02.1.454.light.4.raw

SEQ ID NO: 561874 - DNA, 494 bp, Homo sapiens; identical to SEQ ID NO: 537418
  misc_feature: HIJSMM301E257L.9.1.A01.1.454.light.4.raw

SEQ ID NO: 561875 - DNA, 507 bp, Homo sapiens; identical to SEQ ID NO: 536666
  misc_feature: HIJSMM301C3ZXC.11.57.F02.1.454.light.4.raw

SEQ ID NO: 561876 - DNA, 493 bp, Homo sapiens; identical to SEQ ID NO: 535084
  misc_feature: HIJSMM301CL15C.47.64.F09.1.454.light.4.raw

SEQ ID NO: 561877 - DNA, 486 bp, Homo sapiens; identical to SEQ ID NO: 535043
  misc_feature: HIJSMM301DMH2G.46.35.D02.1.454.light.4.raw

SEQ ID NO: 561878 - DNA, 459 bp, Homo sapiens; identical to SEQ ID NO: 542744
  misc_feature: HIJSMM301D4FHX.11.86.H09.1.454.light.4.raw

SEQ ID NO: 561879 - DNA, 504 bp, Homo sapiens; identical to SEQ ID NO: 535128
  misc_feature: HIJSMM301CSIH1.19.85.H08.1.454.light.4.raw

SEQ ID NO: 561880 - DNA, 497 bp, Homo sapiens; identical to SEQ ID NO: 536376
  misc_feature: HIJSMM301CZ160.22.9.A09.1.454.light.4.raw

SEQ ID NO: 561881 - DNA, 505 bp, Homo sapiens
  misc_feature: HIJSMM301DRSLM.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcaggtggaggctgaggatgttggggtttattactgcatgcaaactacacacggccgctcactttcggcggagggaccaaggtggagatcaaacgaactgtggctgcaccatctgtt

SEQ ID NO: 561882 - DNA, 486 bp, Homo sapiens
  misc_feature: HIJSMM301A7K2P.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagttttatattgtcaacaatattattatacttcgtggacgttcggccaagggaccaaggtggatatcagacgaa

SEQ ID NO: 561883 - DNA, 498 bp, Homo sapiens
  misc_feature: HIJSMM301B0NWX.48.29.C07.1.454.light.4.raw
agtatacatacacgaccggtgctcgatttagagtgctacgaagggaaagggggaggaactgctcagttaggacccagacggaaccatggaagccccagcgcagcttctcttcctcctgctactctggctcccagatgtcactggagaaaaataatgacgcagtctccagtccccctgcctgtgtctccaggggaaagagccaccctctcctgcagagccagtcagagtattagcagtgacttaaccttctacaaccagagacctggccaggctcccaggctcctggccaggtttccaggctcctcatccatggtgcatccaccagggccactggtatctcagccaggttcagtgccagtgggcctgggacagagttcactctcaccatcaccagcctgcagtctgaagattttgcattttattactgtcagcactataataactggccacgtggacgttcggccaagggaccaaggtggaaatcaaacgaactagtgg

SEQ ID NO: 561884 - DNA, 476 bp, Homo sapiens; identical to SEQ ID NO: 541363
  misc_feature: HIJSMM301AQ51A.51.76.G10.1.454.light.4.raw

SEQ ID NO: 561885 - DNA, 481 bp, Homo sapiens
  misc_feature: HIJSMM301C9IZJ.40.23.C01.1.454.light.4.raw
tctagcgactcacgaccggtgctcgatttagtacacgtgattagggattgggggggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagcccaaggcc

SEQ ID NO: 561886 - DNA, 483 bp, Homo sapiens
  misc_feature: HIJSMM301C8P3C.40.83.H06.1.454.light.4.raw
tctagcgactcacgaccggtgctcgatttagatcacgtgcgtcgcgggaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttcagcatgggacggcagcctcagtgaatgggtgttcggcggagggaccaaactgtccgtcctaggtcagcccaa

SEQ ID NO: 561887 - DNA, 492 bp, Homo sapiens; identical to SEQ ID NO: 536671
  misc_feature: HIJSMM301BST7Y.9.34.D01.1.454.light.4.raw

SEQ ID NO: 561888 - DNA, 519 bp, Homo sapiens
  misc_feature: HIJSMM301A0QO6.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggaccaacggtacggtaagtacgaaacgtaaacgtaacgtggcgtgcgaccactactcgtcgttctactcttcccgtccccg

SEQ ID NO: 561889 - DNA, 489 bp, Homo sapiens; identical to SEQ ID NO: 536663
  misc_feature: HIJSMM301ALZUU.16.72.G06.1.454.light.4.raw

SEQ ID NO: 561890 - DNA, 484 bp, Homo sapiens; identical to SEQ ID NO: 535400
  misc_feature: HIJSMM301DYCPY.46.26.C04.1.454.light.4.raw

SEQ ID NO: 561891 - DNA, 483 bp, Homo sapiens
  misc_feature: HIJSMM301C0WZ8.26.12.B01.1.454.light.4.raw
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaataatgatgactcagtctccaggcaccctgtctgtgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccagggtggaggatcagacgaactgt

SEQ ID NO: 561892 - DNA, 506 bp, Homo sapiens
  misc_feature: HIJSMM301CHLHQ.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatggggatgacaatctgagcggttgggtgttcggcggagggaccaaactgacccgtcctagggtcagccccaa

SEQ ID NO: 561893 - DNA, 494 bp, Homo sapiens
  misc_feature: HIJSMM301BY5QX.43.72.G06.1.454.light.4.raw
tgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtggccgcctatgagttgactcagccaccctcagtgtccgtgtccccaggacagacagccagcatcacctgctctggagataaattgggggataaatatgcctcctggtatcagcagaagccaggcgagtcccctgtgttggtcatctatcaagatgacaaacggccctcagggatccctgagcgattctctggctccaactctgggaacacagccactctgaccactcagcgggacccaggctatggatgaggctgacttttactgtcaggcgtgggacaccaacactgtggttttcggcggagggaccaagctgaccgtcctaggtcagcccaaggctgccccctcggtca

SEQ ID NO: 561894 - DNA, 501 bp, Homo sapiens; identical to SEQ ID NO: 536867
  misc_feature: HIJSMM301B7KIL.5.86.H09.1.454.light.4.raw

SEQ ID NO: 561895 - DNA, 505 bp, Homo sapiens
  misc_feature: HIJSMM301DDDUO.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtaggaaatcaaacgaactagtggctgcaccatctgtcttctatcttccccg

SEQ ID NO: 561896 - DNA, 510 bp, Homo sapiens; identical to SEQ ID NO: 538614
  misc_feature: HIJSMM301DC024.19.59.F04.1.454.light.4.raw

SEQ ID NO: 561897 - DNA, 499 bp, Homo sapiens; identical to SEQ ID NO: 536875
  misc_feature: HIJSMM301DYNQX.51.26.C04.1.454.light.4.raw

SEQ ID NO: 561898 - DNA, 510 bp, Homo sapiens
  misc_feature: HIJSMM301B85J0.17.23.C01.1.454.light.4.raw
cgtagactagcacgaccggtgctcgatttagtacacgtgattagggattggggctgggcctaaggaagcagctctggtggtgcctcagccatggcctggaccgttctcctcctcggcctcctctctcactgcacaggctctgtggcctcctatgtgctgactcagccaccctcggtgtcagtggccccaggacagacggccacaattacctgcgggggaaggaacattggaagtaaagtgtgcagtggtaccagcagaagccaggccaggcccctattctggtcgtctatgatgatagcgaccggccctcagggatccctgagcgattctctggctccaactctgacaacacggccaccctgaccatcagtagggtcggagccggggatgagggcgactattactgtcaggtgtgggatcacactagtgatcattatgtcttcggatcgggggaccgaggtcaccgtcctaggtcagcccaagaccaaccccactgtcactctgttccca

SEQ ID NO: 561899 - DNA, 480 bp, Homo sapiens
  misc_feature: HIJSMM301AFMC4.26.12.B01.1.454.light.4.raw
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaataatgatgactcagtctccaggcaccctgtctgtgtctccaggggaaagagtcaccctctcctgcagggccagtcagagtgttagtaacaacttagcctggtaccaacagaaacctggccaggctcccaggctcctcatctatgatgcatccaacagggccactggcatcccagccaggttcagtggcgagtgagtctggacagacttcactctcaccatcagcagcctagagcctgaagattttgactactttatactgtcagcagcgtagcaactggcctcgtcacttcggcggagggaccagggtggagagtcagacgaa

SEQ ID NO: 561900 - DNA, 447 bp, Homo sapiens; identical to SEQ ID NO: 535882
  misc_feature: HIJSMM301EUEGY.18.9.A09.1.454.light.4.raw
  modified_base (429)..(429): a, c, t, g, unknown or other

SEQ ID NO: 561901 - DNA, 496 bp, Homo sapiens
  misc_feature: HIJSMM301C6XX8.16.72.G06.1.454.light.4.raw
tgtactactccacgaccggtgctcgatttagctacgactgcaagggaaagggggagggaactgctcagttaggacccagacggaaccatggaagccccagcgcagcttctcttcctcctgctactctggctcccagatacctctggagaaacagtgatgacgcagtctccagccaccctctctgtgtctccaggggaaagagtcaccctctcctgcagggccagtcagagtgttagcagcaacttagcctggtatcagcagaaacctggccaggctcccaggcccctcatctatgatgcatccaccagggccactggtatcccagccaggttcagtggcagtgggtttgggacagagttcactctcaccatcagcagcctgcagtctgaagattttgcagtttattactgtcagcagtataataactggcctccggtcactttcggcggagggaccgaaggtggagatcaaacgaactgtggctgcaccatctgtt

SEQ ID NO: 561902 - DNA, 502 bp, Homo sapiens; identical to SEQ ID NO: 536253
  misc_feature: HIJSMM301D4YNO.21.22.B11.1.454.light.4.raw

SEQ ID NO: 561903 - DNA, 474 bp, Homo sapiens; identical to SEQ ID NO: 561309
  misc_feature: HIJSMM301BOYFA.5.12.B01.1.454.light.4.raw

SEQ ID NO: 561904 - DNA, 487 bp, Homo sapiens
  misc_feature: HIJSMM301CABBT.43.53.E09.1.454.light.4.raw
tgtgagtagtcacgaccggtgctcgatttagagagagtgtgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccactcggttcagtggcaacggctctgagacagatttttctctcgtcatcactggtctacagtctgacgacggcgcaatgtacttctgtcaacactatgcctctcccccctacaatttcggtcaggggaccaagttgaacatcaatcgaactgtggctgcaccat

SEQ ID NO: 561905 - DNA, 502 bp, Homo sapiens
  misc_feature: HIJSMM301D6AFM.41.42.D09.1.454.light.4.raw
tctatactatcacgaccggtgctcgatttagacacatacgcagggaaagggggaggaactgctcagttaggacccagacggaaccatggaagccccagcgcagcttctcttcctcctgctactctggctcccagatgtcactggagaaatagtgatgacgcagtctccagccaccctgtctgtgtctccaggggaaagagccaccctctcctgcagggccagtcagaatcttagcggcaccttagcctggtaccagcagaaacctggccaggctcccaggctcctcatctatggtacatccaccagggtcactggtgttccagccaggttcagtggcagtgggtccgggacagagttcactctcaccatcagcagcctgcagtctgaagattttgcgatttattactgtcaccactataataattggccctccgcgtggacgttcggccaagggaccaaggtggaaatcaaacgaactagtggctgcaccatctgtcttcta

SEQ ID NO: 561906 - DNA, 499 bp, Homo sapiens
  misc_feature: HIJSMM301BBF2U.16.86.H09.1.454.light.4.raw
tgtactactccacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgattcggcggtgggaccaagctgaccgtcctaggtcagcccaaggctgcccccc

SEQ ID NO: 561907 - DNA, 505 bp, Homo sapiens
  misc_feature: HIJSMM301AOI50.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaagtggatatcaaacgaactagtggctgcaccatctgtctt

SEQ ID NO: 561908 - DNA, 508 bp, Homo sapiens
  misc_feature: HIJSMM301DLPWH.10.88.H11.1.454.light.4.raw
catagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcagtgggtctgggacagacttcactctcaccatcagcagcctggagcctgaagatattgcagtttattattgtcagcagcgtagcaggtggcctttcactttcggcccggggaccaaagtggaaatcaaacgaactgtggctgcaccatctgtcttcatcttcccgcat

SEQ ID NO: 561909 - DNA, 488 bp, Homo sapiens; identical to SEQ ID NO: 546043
  misc_feature: HIJSMM301AL2K4.13.87.H10.1.454.light.4.raw

SEQ ID NO: 561910 - DNA, 497 bp, Homo sapiens
  misc_feature: HIJSMM301BDVH3.41.11.A11.1.454.light.4.raw
tctatactatcacgaccggtgctcgatttagctacgactgcagggggaggaactgctcagttaggacccagacggaaccatggaagccccagcgcagcttctcttcctcctgctactctggctcccagataccactggagaaatagtggtgacgcagtctccagccaccctgtctgtgtctccaggggaaggagccaccctctcctgcagggccagtcagagtattagcagcagcttagcctggtaccagcagaagcctggccaggctcccaggctcctcgtctatggtgcatccaccagggccactggtatcccagccaggttcagtggcagtgggtctgggacagagttcactctcaccatcaccagcctgcagtctgaagattttggagttttatttctgtcaccagtataaggactggccttggtaactttggtccgacgggaccgaagcgtggaggatcagacgaactgtggctgcaccactctcgtcttct

SEQ ID NO: 561911 - DNA, 495 bp, Homo sapiens; identical to SEQ ID NO: 537415
  misc_feature: HIJSMM301BX7HN.4.27.C05.1.454.light.4.raw

SEQ ID NO: 561912 - DNA, 415 bp, Homo sapiens; identical to SEQ ID NO: 536482
  misc_feature: HIJSMM301B9144.16.46.E02.1.454.light.4.raw

SEQ ID NO: 561913 - DNA, 521 bp, Homo sapiens
  misc_feature: HIJSMM301DGJSO.5.27.C05.1.454.light.4.raw
atcagacacgcacgaccggtgctcgatttagacgcgatcgaagggtttggggagtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtctaggtcagccaaggccaaccccactgtcactctcgtcccaccctcctccgttcg

SEQ ID NO: 561914 - DNA, 505 bp, Homo sapiens; identical to SEQ ID NO: 539292
  misc_feature: HIJSMM301B9W4M.19.85.H08.1.454.light.4.raw

SEQ ID NO: 561915 - DNA, 517 bp, Homo sapiens
  misc_feature: HIJSMM301C7QHB.41.19.B08.1.454.light.4.raw
tctatactatcacgaccggtgctcgatttagtgagtcagtaagggggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaacccactgtcactctgttcccgcctcctcat

SEQ ID NO: 561916 - DNA, 498 bp, Homo sapiens
  misc_feature: HIJSMM301ETU0I.9.39.D06.1.454.light.4.raw
tgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaagagccaccctctcctgcagggccagtcagagtgttagtagtaggttagcctggcaccagcaaaaacctggccagcctcccaggctcctcatctatgatgcatccaccaggaccactggtgtcccagccaggttcagtgggagtgggtctgggacagagttcactctcaccatcagcagtctgcagtcggaagattttgcagtttactattgtcagcagtatagtaacgggccgctcactttcggcggagggaccaaggtggagatcaaacgaactgtggctgcaccaatctgtctttca

SEQ ID NO: 561917 - DNA, 513 bp, Homo sapiens; identical to SEQ ID NO: 535244
  misc_feature: HIJSMM301A3QCO.17.33.C11.1.454.light.4.raw

SEQ ID NO: 561918 - DNA, 485 bp, Homo sapiens; identical to SEQ ID NO: 538533
  misc_feature: HIJSMM301CY2A3.47.78.H01.1.454.light.4.raw

SEQ ID NO: 561919 - DNA, 513 bp, Homo sapiens
  misc_feature: HIJSMM301BBFSR.49.27.C05.1.454.light.4.raw
  modified_base (506)..(506): a, c, t, g, unknown or other
agtcgagagacacgaccggtgctcgatttagacgcgatcgaagggtttgggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgccaaaaagatatgcttattggtaccatcagaagtcaggccaggcccctgtactggtcatctatgaggacaccaaacgaccctccgggatccctacgagattctctggctccagtttagggacagtggccaccctgacagtcagtgggcccaggtggaggatgagggtgattactactgttactcaacagacattactactactcatagggtgttcggcggagggaccaagctgaccgtcctaggtcagcccaaggctgccccctcggtcactctgttcccnccctcct

SEQ ID NO: 561920 - DNA, 485 bp, Homo sapiens; identical to SEQ ID NO: 545589
  misc_feature: HIJSMM301DIMK0.26.70.G04.1.454.light.4.raw

SEQ ID NO: 561921 - DNA, 491 bp, Homo sapiens; identical to SEQ ID NO: 535194
  misc_feature: HIJSMM301DF2ZA.26.78.H01.1.454.light.4.raw

SEQ ID NO: 561922 - DNA, 516 bp, Homo sapiens; identical to SEQ ID NO: 537036
  misc_feature: HIJSMM301A8TCF.19.80.H03.1.454.light.4.raw

SEQ ID NO: 561923 - DNA, 488 bp, Homo sapiens; identical to SEQ ID NO: 535990
  misc_feature: HIJSMM301A91RE.11.28.C06.1.454.light.4.raw

SEQ ID NO: 561924 - DNA, 487 bp, Homo sapiens; identical to SEQ ID NO: 537220
  misc_feature: HIJSMM301BHNEI.16.53.E09.1.454.light.4.raw

SEQ ID NO: 561925 - DNA, 498 bp, Homo sapiens
  misc_feature: HIJSMM301E3CT0.13.46.E02.1.454.light.4.raw
tcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcgacagaggccaggccaatctccaaggcgcctaatttataaggtgtctgacagggactccggggtcccagacagattcagcggcagtgggtcaggcactgatttcacactgaaaatcagcagggtggaggctgaggatgttattgggctctattattgcatgcaagcaacacactggccgtacacttttggccagggaccgaagactggaggatcaatacgaactgtggtcg

SEQ ID NO: 561926 - DNA, 452 bp, Homo sapiens
  misc_feature: HIJSMM301CTZFB.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtctaagtcagcccaaggctgccccctggtcactctgttcccgccctcctccacgagagta

SEQ ID NO: 561927 - DNA, 490 bp, Homo sapiens; identical to SEQ ID NO: 549445
  misc_feature: HIJSMM301BNY2L.52.85.H08.1.454.light.4.raw

SEQ ID NO: 561928 - DNA, 505 bp, Homo sapiens
  misc_feature: HIJSMM301ALKVX.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaattgagatcaaacgaactagtggctgcaccatctgtcttcatcttcccgcca

SEQ ID NO: 561929 - DNA, 490 bp, Homo sapiens; identical to SEQ ID NO: 543884
  misc_feature: HIJSMM301CJ37V.41.47.E03.1.454.light.4.raw

SEQ ID NO: 561930 - DNA, 473 bp, Homo sapiens; identical to SEQ ID NO: 547830
  misc_feature: HIJSMM301AXCS2.15.81.H04.1.454.light.4.raw

SEQ ID NO: 561931 - DNA, 476 bp, Homo sapiens; identical to SEQ ID NO: 535171
  misc_feature: HIJSMM301CGPFG.26.72.G06.1.454.light.4.raw

SEQ ID NO: 561932 - DNA, 491 bp, Homo sapiens; identical to SEQ ID NO: 535294
  misc_feature: HIJSMM301A0HCU.16.68.G02.1.454.light.4.raw

SEQ ID NO: 561933 - DNA, 486 bp, Homo sapiens; identical to SEQ ID NO: 537127
  misc_feature: HIJSMM301EW7AM.3.77.G11.1.454.light.4.raw

SEQ ID NO: 561934 - DNA, 504 bp, Homo sapiens
  misc_feature: HIJSMM301DLSZ8.41.55.E11.1.454.light.4.raw
tctatactatcacgaccggtgctcgatttagcactcgcacgttgggtttggggctgggcctcaggaagcagcatcggaggtgcctcagccatggcgtggatccctctcttcctcggcgtccttgcttcctgcacagtttccgtggcctcctcggaattgactcaggcaccctcagtgtccgtgtctccaggacagacagccagaatcacctgctctggagacacgttgggggagacatttgcttcctggtatcaacagaggccaggccagtcccctatcctggtcatctttcaggatgacaaacggccctctggcatccctgaacgcttctctggttccaggtcaggaaacagagccactctaaccatcaccgagacccaggctgtcgatgaggctgactattactgtcaggcctgggacagaaacactggcatattcggcggagggaccaagctgaccgtcctacgtcagcccaaggctgccccctcggtcactctgttcccg

SEQ ID NO: 561935 - DNA, 494 bp, Homo sapiens; identical to SEQ ID NO: 534994
  misc_feature: HIJSMM301CT25P.27.78.H01.1.454.light.4.raw

SEQ ID NO: 561936 - DNA, 494 bp, Homo sapiens; identical to SEQ ID NO: 535276
  misc_feature: HIJSMM301B8TVY.16.6.A06.1.454.light.4.raw

SEQ ID NO: 561937 - DNA, 496 bp, Homo sapiens; identical to SEQ ID NO: 548177
  misc_feature: HIJSMM301C6GXC.18.59.F04.1.454.light.4.raw

SEQ ID NO: 561938 - DNA, 507 bp, Homo sapiens; identical to SEQ ID NO: 556766
  misc_feature: HIJSMM301CG4UW.8.34.D01.1.454.light.4.raw

SEQ ID NO: 561939 - DNA, 498 bp, Homo sapiens
  misc_feature: HIJSMM301DW15Z.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactggaccaaggtcaccgtctagtcagccaaggccaacccactgtca

SEQ ID NO: 561940 - DNA, 444 bp, Homo sapiens; identical to SEQ ID NO: 534993
  misc_feature: HIJSMM301AF3TK.5.9.A09.1.454.light.4.raw

SEQ ID NO: 561941 - DNA, 501 bp, Homo sapiens; identical to SEQ ID NO: 536867
  misc_feature: HIJSMM301APEJ9.5.86.H09.1.454.light.4.raw

SEQ ID NO: 561942 - DNA, 504 bp, Homo sapiens; identical to SEQ ID NO: 535561
  misc_feature: HIJSMM301BC59T.4.57.F02.1.454.light.4.raw

SEQ ID NO: 561943 - DNA, 520 bp, Homo sapiens
  misc_feature: HIJSMM301D47HG.41.33.C11.1.454.light.4.raw
tctatactatcacgaccggtgctcgatttagagtgagctcgttgggtttggggctgggcctaaggaagcagcactggtggtgcctcagccatggcctggaccgttctcctcctcggcctcctctctcactgcacagcctctgtgacctcctatgtgttgactcaaccaccctcggcgtcagtggccctaggacagacggccaggattacctgtggggcaaataagataggaactacaaatgtgcactggtaccaacagaggccaggccaggcccctgtggtggtcgtccatgatgattacgaccggccctcaggaatccctgagcgattctctggctccaattctgggaacacggccaccctgaccatcaccggggtcgaggccggggatgaggccacctactattgtcacgtctgggagactggtgatgatcctgtggcgctattcggcggagggacgaagctgaccgtcctgggtcagcccaaggctgccccctcggtcactctgttcccaccctcct

SEQ ID NO: 561944 - DNA, 460 bp, Homo sapiens; identical to SEQ ID NO: 539553
  misc_feature: HIJSMM301B1SDP.11.86.H09.1.454.light.4.raw

SEQ ID NO: 561945 - DNA, 484 bp, Homo sapiens; identical to SEQ ID NO: 535400
  misc_feature: HIJSMM301BO0RM.46.26.C04.1.454.light.4.raw

SEQ ID NO: 561946 - DNA, 508 bp, Homo sapiens; identical to SEQ ID NO: 540739
  misc_feature: HIJSMM301BHZCM.14.7.A07.1.454.light.4.raw

SEQ ID NO: 561947 - DNA, 494 bp, Homo sapiens; identical to SEQ ID NO: 536974
  misc_feature: HIJSMM301A71J2.16.86.H09.1.454.light.4.raw

SEQ ID NO: 561948 - DNA, 473 bp, Homo sapiens
  misc_feature: HIJSMM301B3RNU.8.67.G01.1.454.light.4.raw
ctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaattggtatcaacagagcccaggaaaagcccccaaactcctgatttatggtgcatccatttcgcaaagtggggtcccatcaaggttcagtggcagtggatctggggcagatttcaccctcaccatcagcagtctgcaacctgaagactttgcaacttactactgtcagcagtcttacagtaggccgggcacctttggccagggacgaagctggagatcgaacgaactgtggctgcaccatctgtcttcatccttcccgccatctgagacacgcgag

SEQ ID NO: 561949 - DNA, 496 bp, Homo sapiens
  misc_feature: HIJSMM301D32PD.41.3.A03.1.454.light.4.raw
tctatactatcacgaccggtgctcgatttagagagcgtcacaggggagagctgctcagttaggacccagagggaaccatggaaaccccagcgcagcttctcttcctcctgctactctggctcccaggtgccaccggagaaattgtgttgacgcagtctccaggcaccctgtctttctctccaggggaaagagccaccctctcctgcagggccagtcagagtgttgacaaccagtacttcgcctggtaccagcagaaacctggccaggctcccaggctcctcatggatggtgcatccagcagggccactggcatcccagacaggttcggtggcagtgggtctgggacagacttcactctcaccatcagcagcctggagcctgaagatttgtagtgtattactgtcagcagtatcttacaacaccggggagttttggccaggggaccaagctggagatcaaacgaactgtggctgcaccatctgtcttcatcttcccg

SEQ ID NO: 561950 - DNA, 516 bp, Homo sapiens
  misc_feature: HIJSMM301E06BW.40.12.B01.1.454.light.4.raw
tctagcgactcacgaccggtgctcgatttagtagtgtagattccgcggggtggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaactacacccaggcaaagcccccaaactcatgatttctgacgtcagtaagcggccctcaggggtccctgatcgcttctctggctccaagtctggcaacacggcctccctgaccgtctctgggctccaggctgaagatgaggctgattattactgctactcgtatgcaggcggcaacaattgggtctttcggcggagggaccgaagctgaccgtcctaggtcagcccaaggctgcccctcggtcactctgttcccg

SEQ ID NO: 561951 - DNA, 501 bp, Homo sapiens
  misc_feature: HIJSMM301BUVEK.19.71.G05.1.454.light.4.raw
tactctcgtgcacgaccggtgctcgatttagtgtcgtcgcaagagagaggggggggtacgaacaggcaggcaggggcgagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccgaaggtggtagtatcagacgaactgtgggctgca

SEQ ID NO: 561952 - DNA, 516 bp, Homo sapiens
  misc_feature: HIJSMM301CVFOD.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctggcgactttgcagtttatttctgtcagcagtctgaagactggccgttcactttcggtcggagggaccgaaggtaggaccgtcaaacgaaactgtggcgtgcaccatctgtcttctatcttcccgtccact

SEQ ID NO: 561953 - DNA, 432 bp, Homo sapiens; identical to SEQ ID NO: 535811
  misc_feature: HIJSMM301EPIZE.14.5.A05.1.454.light.4.raw

SEQ ID NO: 561954 - DNA, 487 bp, Homo sapiens; identical to SEQ ID NO: 538190
  misc_feature: HIJSMM301BACO2.47.70.G04.1.454.light.4.raw

SEQ ID NO: 561955 - DNA, 501 bp, Homo sapiens; identical to SEQ ID NO: 537690
  misc_feature: HIJSMM301CCHNY.41.14.B03.1.454.light.4.raw

SEQ ID NO: 561956 - DNA, 507 bp, Homo sapiens
  misc_feature: HIJSMM301DOPA2.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccacctgaccatcagcagggtcgaagccggggatgaggccgactattactgtcaggtgtgggatagtagtggtgatcatccatacgtcttcggaactgggaccaaggtctccgtcctacgtcagcccaaggccaacccactgtcactctgttcccg

SEQ ID NO: 561957 - DNA, 502 bp, Homo sapiens
  misc_feature: HIJSMM301B4HLG.13.10.A10.1.454.light.4.raw
tcacgtactacacgaccggtgctcgatttagcgtcgatctcaggggggaagcctgggaacacttagccttcatgagtatccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatctacaacacaaacactcgctcttctggggtccctcatcgcttctctggctccatccttgggaacaaagctgcccttatcatcacgggggcccaggcagaagatgaatctgattattactgtgttctttatatgggtagtgccatttctgctgtgttcggaggaggcacccggctgaccgtcctaggtcagcccaaggctgccccctcggt

SEQ ID NO: 561958 - DNA, 478 bp, Homo sapiens; identical to SEQ ID NO: 535129
  misc_feature: HIJSMM301DX8NJ.11.11.A11.1.454.light.4.raw

SEQ ID NO: 561959 - DNA, 473 bp, Homo sapiens; identical to SEQ ID NO: 538060
  misc_feature: HIJSMM301ALJDD.18.76.G10.1.454.light.4.raw

SEQ ID NO: 561960 - DNA, 513 bp, Homo sapiens; identical to SEQ ID NO: 555055
  misc_feature: HIJSMM301CARC4.15.76.G10.1.454.light.4.raw

SEQ ID NO: 561961 - DNA, 504 bp, Homo sapiens; identical to SEQ ID NO: 538940
  misc_feature: HIJSMM301E2JG4.2.35.D02.1.454.light.4.raw

SEQ ID NO: 561962 - DNA, 493 bp, Homo sapiens
  misc_feature: HIJSMM301BJ9J8.41.2.A02.1.454.light.4.raw
tctatactatcacgaccggtgctcgatttagactcatctacagggggtcagtcccaaccaggacacagcatggacatgagggtccctgctcagctcctggggctcctgctgctctggctctcaggcgccagatgtgacatccagatgacccagtctccatcctccctgtctgcatctttaggagacagagtcaccatctcttgtcaggcgaatgaggacattaacgtttatttaaattggtatcggcagagaccagggaaagcccctgagctcctgatttatgataaatcgaatttgaatccaggggtcccatctaggttccgtggaagtggatctgggacagactttactctcaccattagcagcctggagcctgaagatattgcaacatattactgtcaacagtctcatggtctcccccttagtttcggcggagggaccaaggttgagatcaaacgaactgtggctgcaccatctgtcttcatcttccccg

SEQ ID NO: 561963 - DNA, 492 bp, Homo sapiens; identical to SEQ ID NO: 537666
  misc_feature: HIJSMM301DG7OJ.43.33.C11.1.454.light.4.raw

SEQ ID NO: 561964 - DNA, 485 bp, Homo sapiens; identical to SEQ ID NO: 536075
  misc_feature: HIJSMM301DYX23.17.21.B10.1.454.light.4.raw

SEQ ID NO: 561965 - DNA, 505 bp, Homo sapiens; identical to SEQ ID NO: 535503
  misc_feature: HIJSMM301CMHI9.8.28.C06.1.454.light.4.raw

SEQ ID NO: 561966 - DNA, 503 bp, Homo sapiens; identical to SEQ ID NO: 537189
  misc_feature: HIJSMM301ARWYM.19.85.H08.1.454.light.4.raw

SEQ ID NO: 561967 - DNA, 497 bp, Homo sapiens
  misc_feature: HIJSMM301B63T2.12.38.D05.1.454.light.4.raw
atacgacgtacacgaccggtgctcgatttagtatctgatagttgggtttgggggaactgctcagttaggacccagacggaaccatggaagccccagcgcagcttctcttcctcctgctactctggctcccagattcctctggagaagttgtgatgacgcagtctccagccaccctgtctgcgtctccaggggaaagagtcaccctctcatgcagggccagtgagattgttaccaccaacttagcctggtaccaacagaaacctggccagcctcccaggctcctcatttatggtgcatccacaagggccgctggtgtcccagccaggttcagtggcagtggatctgcgacagagttcactctcaccgtcagcagcctgcagtctgaagattttgcagtttattactgtcagcagtatgagaagtggttcaagactttcggcggagggaccgaaggtggaggatcaaacgaactagtggctgcaccatctgtcttcatt

SEQ ID NO: 561968 - DNA, 496 bp, Homo sapiens; identical to SEQ ID NO: 551939
  misc_feature: HIJSMM301C8Z4T.19.71.G05.1.454.light.4.raw

SEQ ID NO: 561969 - DNA, 511 bp, Homo sapiens
  misc_feature: HIJSMM301D9EA2.43.67.G01.1.454.light.4.raw
tgtgagtagtcacgaccggtgctcgatttagagtatacatattgggtttgggggagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgttatactccgccgacgttcgtccggggaccgaccgtcggaaatacaaacgaactagtggctgcaccatctgtctt

SEQ ID NO: 561970 - DNA, 503 bp, Homo sapiens
  misc_feature: HIJSMM301DB1MG.11.59.F04.1.454.light.4.raw
cgagagataccacgaccggtgctcgatttagtacacacacttagggagttggggggctttgcctgggctctgctcctcctcagcctcctcactcagggcacaggatcctcgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagcccccaagtcgttctctatgatgtcactaacgcggccctcaggagtccctgatcgattctctggctccaagtctggcaacacggcctccctgaacatctctgggctccgaggctgaggatgaggctgattattattgctgctcatatggaagtacctactcttttctcttcggaactgggaccacggtcaccgtctaggtcagcccaaggccaaccccactgtcactctcgttcccgccctcctcgtatctctcg

SEQ ID NO: 561971 - DNA, 484 bp, Homo sapiens; identical to SEQ ID NO: 536162
  misc_feature: HIJSMM301C36MY.13.59.F04.1.454.light.4.raw

SEQ ID NO: 561972 - DNA, 498 bp, Homo sapiens
  misc_feature: HIJSMM301EQ80K.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgacccatcactggggctcaggcggaagatgaggctgactattactgtaactcccgggccagcagtggtaacattgtgatattcggcggagggaccaaggtgaccgtcctacgtcagcccaaggctgccccctcggtcactctcg

SEQ ID NO: 561973 - DNA, 476 bp, Homo sapiens; identical to SEQ ID NO: 549636
  misc_feature: HIJSMM301EOS8W.41.5.A05.1.454.light.4.raw

SEQ ID NO: 561974 - DNA, 492 bp, Homo sapiens
  misc_feature: HIJSMM301DQP86.15.67.G01.1.454.light.4.raw
tctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagatttcactctcaccatcagcagcctgcagcctgaagatttcgcaacttattactgtctacaagattacaattaccctcggacgttcggtccagggaccgaaggtggaaatactaaacgaactagtggctgcaccta

SEQ ID NO: 561975 - DNA, 501 bp, Homo sapiens
  misc_feature: HIJSMM301DBUWD.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccaagggaccaaggtggaaagtacaaacgaactagtggctgcacc

SEQ ID NO: 561976 - DNA, 503 bp, Homo sapiens; identical to SEQ ID NO: 561871
  misc_feature: HIJSMM301A4EHL.19.85.H08.1.454.light.4.raw

SEQ ID NO: 561977 - DNA, 497 bp, Homo sapiens; identical to SEQ ID NO: 535664
  misc_feature: HIJSMM301EY0A4.22.14.B03.1.454.light.4.raw

SEQ ID NO: 561978 - DNA, 488 bp, Homo sapiens; identical to SEQ ID NO: 537260
  misc_feature: HIJSMM301DP9MT.47.70.G04.1.454.light.4.raw

SEQ ID NO: 561979 - DNA, 508 bp, Homo sapiens
  misc_feature: HIJSMM301BWYW4.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgccccctggtcactctgtt

SEQ ID NO: 561980 - DNA, 495 bp, Homo sapiens
  misc_feature: HIJSMM301AGBC2.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagcggcctgcagtctgaagattttgctagtttattactgtcagcagtataatgactgggttttattctactttcggccctgggaccaaagtggtatttcagacgaactgtggctgcaccatctgtcttcta

SEQ ID NO: 561981 - DNA, 494 bp, Homo sapiens; identical to SEQ ID NO: 535276
  misc_feature: HIJSMM301B3Z7U.16.6.A06.1.454.light.4.raw

SEQ ID NO: 561982 - DNA, 479 bp, Homo sapiens
  misc_feature: HIJSMM301EZBSJ.48.83.H06.1.454.light.4.raw
agtatacatacacgaccggtgctcgatttagatcacgtgcgtcgcgggcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcagggctgactcagccaccctcggtgtccaagggcttgagacagaccgccacaatcacctgcactgggaacaacaataatgtcgccaaccaaggagcagcttggctgcagcagcaccagggccaccctcccaaagtcgtatccgacagggataacaatcggcccttagggatctcagagagaatatctgcatccaggtcaggaaacacagcctccctgaccattactggactccaacctgaggacgaggctgactattattgctcagcatgggacaccagcctcaatgccc

SEQ ID NO: 561983 - DNA, 507 bp, Homo sapiens
  misc_feature: HIJSMM301C3FEH.5.24.C02.1.454.light.4.raw
atcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgataaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaaggctgaccgtcctaggtcagcccaaggctgccccccg

SEQ ID NO: 561984 - DNA, 510 bp, Homo sapiens
  misc_feature: HIJSMM301C2E33.11.1.A01.1.454.light.4.raw
cgagagataccacgaccggtgctcgatttagacgtctcatcaggggaggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtgggcaggtcagcccaaggccaacccactcgtcactcc

SEQ ID NO: 561985 - DNA, 488 bp, Homo sapiens
  misc_feature: HIJSMM301AV7XF.5.40.D07.1.454.light.4.raw
atcagacacgcacgaccggtgctcgatttagtgatagagcgtaacaacagaggggggaactgctcagttaggacccagacggaaccatggaagccccacgcgcagcttctcttcctcctgctactctggctcccagataccattggagagatagtgatgacgcagtctccagccaccctgtctgtgtctccaggggaaagagccaccctctcctgcagggccagccagagtgtaagtagtaggttagcctggtatcagcagaaacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcaacagtataatgactggtggacgttcggccaagggaccaaggtggagaccaaacgaactgtggctgcaccatctgt

SEQ ID NO: 561986 - DNA, 489 bp, Homo sapiens
  misc_feature: HIJSMM301EQC5A.47.36.D03.1.454.light.4.raw
agctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacttgtcgggcgagtcagggtattagcaactggttagcctggtatcaacagaaaccagggaaagcccctaacctcctcatctctactgcatccactttgcaaagtggggtcccatcaaggttcagcggcagtggatctgggacagatttcactctcactatcagcagcctgcagcctgaagatttggaacttattattgtcaacagggtaacagtttcccgctcaccttcggcggagggaccaaggtggagatgaaaagaactagtggctgcaccat

SEQ ID NO: 561987 - DNA, 500 bp, Homo sapiens
  misc_feature: HIJSMM301CZ8EH.18.23.C01.1.454.light.4.raw
tacgagtatgcacgaccggtgctcgatttagtacacgtgattagggattgggggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaacctggttagtttggtatcagcagaaaccaggaaaagcccctaagctgcagatgattggtccgtccagtttccaagatggggccccatcgagattccgcgtcagtggatctgggacagatttcactctcaccatcagcagcctgtagcctgaagattttgcaacttactattgtcagcaggcgcacaatttcccgctcactttcggcggagggaccaaggtggagatcaaacgaactgtggctgcaccatctgtcttcatcttcccg

SEQ ID NO: 561988 - DNA, 505 bp, Homo sapiens
  misc_feature: HIJSMM301A56K2.12.50.E06.1.454.light.4.raw
atacgacgtacacgaccggtgctcgatttagatctactgacaacacacaaggggggagaagagctgctcagttaggacccagagggaaccatggaaaccccagcgcagcttctcttcctcctgctactctggctcccagataccaccggagaaattgtgttgacgcagtctccaggcaccctgtctttgtctccgggggaaagagtcaccctctcctgcagggccagtcagagtgttagcggcaactacttagcctggtaccaacagaaacctggccaggctcccaggctcgtcatctatggtgcatccagcagggccactggcatcccagacaggttcagtggcagtgggtctggggacagacttcactctcaccatcagtagactggagcctgaagattttgcagtttattactgtcagcagtatgggggctcacgtcgattcactttcggccctgggaccaaagtaagatgtcaaacgaactgtggctgcaccatctgtctt

SEQ ID NO: 561989 - DNA, 490 bp, Homo sapiens; identical to SEQ ID NO: 535234
  misc_feature: HIJSMM301D7M64.17.21.B10.1.454.light.4.raw

SEQ ID NO: 561990 - DNA, 462 bp, Homo sapiens
  misc_feature: HIJSMM301AWV6L.52.49.E05.1.454.light.4.raw
cgcagtacgacacgaccggtgctcgatttagagcgactagcaacacacaaaggggagtctcagtcaggacacagcatggacatgagggtccccgctcagctcctggggctcctgctactctggctccgaggtgccagatgtgacatccagatgacccagtctccatcctccctgtctgcatctgtaggagacgaagtcaccatgacttgccgggcaagtcagagcattagcagccatttgaattggtatcagcagaaacctgggaaagcccctcagctcctgatctttgctgcatccagtttgcacagtggggtcccatcaaggttcagtggcagtggatctgggacagacttcactctcaccatcagcagtctgcaacctgaggattttgccacttactactgtcaacagacttacaatacccctccatacacttttggtccaggggaccaagctggagat

SEQ ID NO: 561991 - DNA, 508 bp, Homo sapiens
  misc_feature: HIJSMM301DWDBS.10.27.C05.1.454.light.4.raw
catagtagtgcacgaccggtgctcgatttagacgcgatcgaaggggtttggggggggtcgacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggggtttctagtcgcttctctgcctccaagtctggcaacacggcctccctgacaatctctgggctccaggctgacgacgaggctgaatattactgcagctcatatgtagatggtgcctctttcaaggttttcggcggagggaccaggctgaccgtcctaagtcagcccaaggctgccccctcggt

SEQ ID NO: 561992 - DNA, 506 bp, Homo sapiens
  misc_feature: HIJSMM301B0YT6.8.71.G05.1.454.light.4.raw
  modified_base (458)..(458): a, c, t, g, unknown or other
ctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaccagggaaagcccctaaatacctggtctatactgcatccactttgcaaagtggggtcccatcaaggttcagtggcagtggatttgggacagttttcactctcacaatcagcagtctcgaacctgaagattttgcaacttactactgtcaacagacttacaatataccgaggacgttcggtcaagggaccaaggtaggngatcaaacgaactgtggctgcaccatctgtcttcatctttcccgccat

SEQ ID NO: 561993 - DNA, 487 bp, Homo sapiens
  misc_feature: HIJSMM301C7LOI.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgaggcgggccaccagtcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttatattgtcaacaatattattatacttcgtggacgttcggccaagggaccaaggtggatatcagacgaa

SEQ ID NO: 561994 - DNA, 480 bp, Homo sapiens; identical to SEQ ID NO: 535291
  misc_feature: HIJSMM301BGQSA.22.59.F04.1.454.light.4.raw

SEQ ID NO: 561995 - DNA, 496 bp, Homo sapiens
  misc_feature: HIJSMM301A7D3P.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccagggaccaagctggagatcaaacgaactgtggctgcaccatctgtt

SEQ ID NO: 561996 - DNA, 498 bp, Homo sapiens
  misc_feature: HIJSMM301AP9PK.52.55.E11.1.454.light.4.raw
cgcagtacgacacgaccggtgctcgatttagcactcgcacgttgggtttggggaggaactgctcagttaggacccagagggaaccatggaagccccagctcagcttctcttcctcctgctactctggctcccagataccaccggagaagttgtattgacacagtctccagccaccctgtctttgtctccaggggggagagccaccctctcctgcagggccagtcagagtgttggcaacctcttagcctggtaccaacaaaacctggccaggctcccaggctcctcatctatgatgcatccacgagggccactggcatcccagccaggttcagtggcagtgggtctgagacagacttcactctcaccatcagtggcctcgagcctgaagattttgcagtttattactgtcagcagcgtagccactggctctctttcggcggagggaccaaggttgagatcaaacgaactgtggctgcaccatctgtcttcatcttcccg

SEQ ID NO: 561997 - DNA, 505 bp, Homo sapiens; identical to SEQ ID NO: 551816
  misc_feature: HIJSMM301AKSCA.18.78.H01.1.454.light.4.raw

SEQ ID NO: 561998 - DNA, 489 bp, Homo sapiens; identical to SEQ ID NO: 535139
  misc_feature: HIJSMM301EB9C4.14.55.E11.1.454.light.4.raw

SEQ ID NO: 561999 - DNA, 383 bp, Homo sapiens; identical to SEQ ID NO: 550682
  misc_feature: HIJSMM301D9DJK.48.87.H10.1.454.light.4.raw

SEQ ID NO: 562000 - DNA, 535 bp, Homo sapiens
  misc_feature: HIJSMM301B7RFU.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggtccaacgggaccgaacggtaggaaggtacgaaacgaaacctagtaggcgtggcaccactctcgtcttctactcttcccgtcccactctcgataacg

SEQ ID NO: 562001 - DNA, 487 bp, Homo sapiens; identical to SEQ ID NO: 557907
  misc_feature: HIJSMM301CILVM.5.40.D07.1.454.light.4.raw

SEQ ID NO: 562002 - DNA, 434 bp, Homo sapiens; identical to SEQ ID NO: 536762
  misc_feature: HIJSMM301EE2PD.48.1.A01.1.454.light.4.raw

SEQ ID NO: 562003 - DNA, 494 bp, Homo sapiens; identical to SEQ ID NO: 539894
  misc_feature: HIJSMM301CYQN0.16.53.E09.1.454.light.4.raw

SEQ ID NO: 562004 - DNA, 475 bp, Homo sapiens
  misc_feature: HIJSMM301C4U57.13.38.D05.1.454.light.4.raw
tcacgtactacacgaccggtgctcgatttagtatctgatagttgggtttgggggagtcagtctcagtcaggacacagcatggacatgagggtccccgctcagctcctggggctcctgctactctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacaggggtcccatcaaggttcagtggaagtggatctgggacagattttactttcaccatcagcagcctgcagcctgaagatattgcaacatattactgtcagcagtatgataatctcccgatcaccttcggccaagggacacgactggagattaaacgaactgtgg

SEQ ID NO: 562005 - DNA, 504 bp, Homo sapiens; identical to SEQ ID NO: 539091
  misc_feature: HIJSMM301CB4WD.8.28.C06.1.454.light.4.raw

SEQ ID NO: 562006 - DNA, 490 bp, Homo sapiens; identical to SEQ ID NO: 535936
  misc_feature: HIJSMM301CDBJQ.16.68.G02.1.454.light.4.raw

SEQ ID NO: 562007 - DNA, 502 bp, Homo sapiens
  misc_feature: HIJSMM301AIMU1.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaggagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggcccaa

SEQ ID NO: 562008 - DNA, 493 bp, Homo sapiens; identical to SEQ ID NO: 537281
  misc_feature: HIJSMM301C4UPD.9.1.A01.1.454.light.4.raw

SEQ ID NO: 562009 - DNA, 507 bp, Homo sapiens; identical to SEQ ID NO: 536226
  misc_feature: HIJSMM301EB7IA.18.37.D04.1.454.light.4.raw

SEQ ID NO: 562010 - DNA, 477 bp, Homo sapiens
  misc_feature: HIJSMM301CP33D.11.17.B06.1.454.light.4.raw
cgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccgggcaagtcagatcattagcagctatttaaattggtatcagcagaaaccagggaaagcccctgaggtcctgatctatgctgcatccagtttgcagagtggggtcccatcaaggttcagtggcagtggatctgcgacagatttcactctcaccatcagcagtctgcaacctgaagattttgcaacttactactgtcaacagagttacagtaccccgtggaccgttcggccaagggaccaaggtggaaatcaacgaactgtggctgca

SEQ ID NO: 562011 - DNA, 496 bp, Homo sapiens; identical to SEQ ID NO: 538625
  misc_feature: HIJSMM301DC88L.2.49.E05.1.454.light.4.raw

SEQ ID NO: 562012 - DNA, 498 bp, Homo sapiens; identical to SEQ ID NO: 542913
  misc_feature: HIJSMM301C939D.51.26.C04.1.454.light.4.raw

SEQ ID NO: 562013 - DNA, 350 bp, Homo sapiens; identical to SEQ ID NO: 537421
  misc_feature: HIJSMM301DJWWV.13.11.A11.1.454.light.4.raw

SEQ ID NO: 562014 - DNA, 486 bp, Homo sapiens; identical to SEQ ID NO: 538568
  misc_feature: HIJSMM301BRK6I.47.38.D05.1.454.light.4.raw

SEQ ID NO: 562015 - DNA, 490 bp, Homo sapiens
  misc_feature: HIJSMM301AJX27.19.71.G05.1.454.light.4.raw
tactctcgtgcacgaccggtgctcgatttagtgtcgtcgcaagagagaggggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttatattgtcaacaatattattatacttcgtggacgttcggccaagggaccaaggtggatatcagacgaactgtgg

SEQ ID NO: 562016 - DNA, 496 bp, Homo sapiens; identical to SEQ ID NO: 535541
  misc_feature: HIJSMM301E2EMV.3.33.C11.1.454.light.4.raw

SEQ ID NO: 562017 - DNA, 477 bp, Homo sapiens
  misc_feature: HIJSMM301AHXFK.51.60.F05.1.454.light.4.raw
cgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaagcggccctcggggatacctgagcgattctctggctccacctctgggaacacagccactctgaccatcagcgggacgcaggctgtggatgaggctgactttactgtcaggcgtgggacagcgacactgccgtgttcggcggagggaccaagctgaccgtcctcgtcagccaaggctcg

SEQ ID NO: 562018 - DNA, 505 bp, Homo sapiens; identical to SEQ ID NO: 537876
  misc_feature: HIJSMM301A5746.5.68.G02.1.454.light.4.raw

SEQ ID NO: 562019 - DNA, 504 bp, Homo sapiens; identical to SEQ ID NO: 535077
  misc_feature: HIJSMM301EHG7I.8.28.C06.1.454.light.4.raw

SEQ ID NO: 562020 - DNA, 511 bp, Homo sapiens
  misc_feature: HIJSMM301ASHRW.10.71.G05.1.454.light.4.raw
catagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggtcggagggaccgaaaactaagaaggtcgaaacgaactagtggcgtgcaccactctgtcttctat

SEQ ID NO: 562021 - DNA, 494 bp, Homo sapiens; identical to SEQ ID NO: 534992
  misc_feature: HIJSMM301AQI1E.9.1.A01.1.454.light.4.raw

SEQ ID NO: 562022 - DNA, 503 bp, Homo sapiens
  misc_feature: HIJSMM301A551K.21.81.H04.1.454.light.4.raw
tcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacgaggctgattattactgcaggtcatatacaatcagcaacacttatgtcttcgggactgggaccaagatcaccgtcctaggtcagcccaaggcccaacccactgtcta

SEQ ID NO: 562023 - DNA, 472 bp, Homo sapiens; identical to SEQ ID NO: 536302
  misc_feature: HIJSMM301C7BZF.18.76.G10.1.454.light.4.raw

SEQ ID NO: 562024 - DNA, 520 bp, Homo sapiens; identical to SEQ ID NO: 539176
  misc_feature: HIJSMM301BUX2D.27.23.C01.1.454.light.4.raw

SEQ ID NO: 562025 - DNA, 495 bp, Homo sapiens
  misc_feature: HIJSMM301C98KN.52.53.E09.1.454.light.4.raw
cgcagtacgacacgaccggtgctcgatttagagagagtgtgttgggtttggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtattagcaactacttagcctggtaccaacagaaacctggccaggctcccaggctcctcatctatgatgcgtccaacagggccactggcatcccagccaggttcagtggcggtgggtctgggacagacttcactctcaccatcagcagcctagagcctgaagattttgcagtttattactgtcagcagcgtagcaactggcctcgatcacttcgcaagggacacgactggagattaaacgaactgtggctgcaccatctgtcttcatt

SEQ ID NO: 562026 - DNA, 504 bp, Homo sapiens
  misc_feature: HIJSMM301B2BJA.9.71.G05.1.454.light.4.raw
tgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcggagggaccaggctgaccgtcctgagtcagcccaaggctgccccccg

SEQ ID NO: 562027 - DNA, 502 bp, Homo sapiens
  misc_feature: HIJSMM301BM60Y.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccagggtccctgaccgattcagtggcagcgggtctgggacagatttcactctcaccatcagcagcctgcaggctgaagatgtggcagtttattactgtcaacagttttctcgggcgttcgccgaacggaccgaacggtggaaatacaaacgaacctagtggcgtgcgaccatctgtcttcatt

SEQ ID NO: 562028 - DNA, 506 bp, Homo sapiens; identical to SEQ ID NO: 559720
  misc_feature: HIJSMM301CIZBL.15.86.H09.1.454.light.4.raw

SEQ ID NO: 562029 - DNA, 503 bp, Homo sapiens
  misc_feature: HIJSMM301EGIL4.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtccagcccaa

SEQ ID NO: 562030 - DNA, 517 bp, Homo sapiens
  misc_feature: HIJSMM301AI7IM.8.23.C01.1.454.light.4.raw
ctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtggggggttcaatattggaggtaacaatgtgcactggtaccagcagaaggcagggcaggcccctgtactggtcatctatgggggatccatccggccaggtgggacccctgcgcgattctctgcctccatctcggggaacgcggccaccctgaccatcagcaaagcccaagccggtgatgaggctgactatttttgcaggtgtgggacagcagcatttatgtcttcggacctgggaccaaggtcaccgtcctaggtcagccccaaggccaaacccccactgtcactctgttccccaccctcctcga

SEQ ID NO: 562031 - DNA, 502 bp, Homo sapiens
  misc_feature: HIJSMM301C49DF.48.53.E09.1.454.light.4.raw
agtatacatacacgaccggtgctcgatttagagagagtgtgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcaaaaacctggccaaactcccaggctcctcatctatggtgcatccaccagggccactggaatcccaaccaggttcagtggcagagggtctgggacggaattcactctcaccatcagcagtctgcagtctgaagattttgcagtttattattgtcagcagtataataattggcctccgggggtcactttcggccctgggaccaaataaatgtcaatcgaactgtggctgcaccatctgtcttcatt

SEQ ID NO: 562032 - DNA, 487 bp, Homo sapiens
  misc_feature: HIJSMM301EJGBN.48.27.C05.1.454.light.4.raw
agtatacatacacgaccggtgctcgatttagacgcgatcgaagggtttggggagagctctggagaagagctgctcagttaggacccagagggaaccatggaagccccagcgcagcttctcttcctcctgctactctggctcccagaaagcaccggagacattgaactgacgcagtctccaggcaccctgtctttgtctccaggggaaagagccaccctctcctgcagggccggtcggagtctttccagcacctacttagcctggtaccaacaaaaagctggccaggctcccaggctcctcatatatgatgtttctaccagggccactggcattccagacaggttcagtggcagtgggtctgggacagacttcactctcaccatcaacagattggagcctgaagactctgcagtctatttctgtcagcaatatcgcagttcagtctcgtgcacttttggccaggggaccacgctggagatcaaacgaa

SEQ ID NO: 562033 - DNA, 510 bp, Homo sapiens
  misc_feature: HIJSMM301DM0FR.15.76.G10.1.454.light.4.raw
tctacgtagccacgaccggtgctcgatttagtcactcatacagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctggtcactctgttcccgcctcctcgctacg

SEQ ID NO: 562034 - DNA, 498 bp, Homo sapiens; identical to SEQ ID NO: 546236
  misc_feature: HIJSMM301AOTV1.52.38.D05.1.454.light.4.raw

SEQ ID NO: 562035 - DNA, 482 bp, Homo sapiens
  misc_feature: HIJSMM301A6EJA.43.76.G10.1.454.light.4.raw
tgtgagtagtcacgaccggtgctcgatttagtcactcatacaggggactgcgggggtaagaggttgtgtccaccatggcctggactcctctcctcctcctgttcctctctcactgcacaggttccctctcgcaggctgtgctgactcagccgtcttccctctctgcatctcctggagcatcagccagtctcacctgcaccttgcgcgttggcatcaatgttgctacccacacaatatactggtaccagcagaagtcagggagtcctccccagtttctcctgaggtacaaatcagactcagataagcagcagggctctggaatccccagccgcttctctggatccaaggatgcttcggccaatgcaggaattttgctcatctctgggctccagtctgaggatgaggctgactattactgtacgatttggcacaacgacgctgtggtttcggcggagggaccaagctgaccgtcctaagtcacg

SEQ ID NO: 562036 - DNA, 466 bp, Homo sapiens
  misc_feature: HIJSMM301CSZIB.5.36.D03.1.454.light.4.raw
atcagacacgcacgaccggtgctcgatttagctgcgtcacgatctctcttgggggagtcagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtggggtcccaccaacgttcagcggcagtggatctgggacagagttcactctcaccatcagcagcctgcagcctgacatgtggcaacttattactgccaacagtatgatagttattggacgttcggccaagggaccaagatagaaatcaaacgaa

SEQ ID NO: 562037 - DNA, 486 bp, Homo sapiens; identical to SEQ ID NO: 535043
  misc_feature: HIJSMM301EUD1W.46.35.D02.1.454.light.4.raw

SEQ ID NO: 562038 - DNA, 470 bp, Homo sapiens
  misc_feature: HIJSMM301APVN0.51.67.G01.1.454.light.4.raw
cgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattactgtcaacagtatgatagtctcccgctcactttcggcgggggccgaacggtggagatcaagcgaactgtgg

SEQ ID NO: 562039 - DNA, 485 bp, Homo sapiens; identical to SEQ ID NO: 545359
  misc_feature: HIJSMM301B29OT.52.53.E09.1.454.light.4.raw

SEQ ID NO: 562040 - DNA, 485 bp, Homo sapiens; identical to SEQ ID NO: 536075
  misc_feature: HIJSMM301DMVKZ.17.21.B10.1.454.light.4.raw

SEQ ID NO: 562041 - DNA, 505 bp, Homo sapiens; identical to SEQ ID NO: 542298
  misc_feature: HIJSMM301DCHOX.14.3.A03.1.454.light.4.raw

SEQ ID NO: 562042 - DNA, 492 bp, Homo sapiens
  misc_feature: HIJSMM301AJC58.48.25.C03.1.454.light.4.raw
agtatacatacacgaccggtgctcgatttagtagtgtagatttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctgccccctc

SEQ ID NO: 562043 - DNA, 494 bp, Homo sapiens
  misc_feature: HIJSMM301BSG3A.52.38.D05.1.454.light.4.raw
cgcagtacgacacgaccggtgctcgatttagtatctgatagttgggttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgtcact

SEQ ID NO: 562044 - DNA, 497 bp, Homo sapiens
  misc_feature: HIJSMM301CXW95.2.34.D01.1.454.light.4.raw
acgctcgacacacgaccggtgctcgatttagatcgtctgtgttgggtttgggggctttgcctgggctctgctcctcctcaccctcctcactcagggcacagggtcctgggcccagtctgccctgactcagcccccctccgcgtccgggtctcctggacagtcagtcaccatctcctgcactggaatcagcagtgacctgagtccttataactatgtctcctggtaccaacaacacccaggcaaagcccccaaactcattatttatgaagtcactaagcggccctcaggggtccctgatcgcttctctggctccaagtctggcgagacggcctccctgaccgtctctgggctccaggctgaagatgaggctgattattactgcagctcatatgcaggcagcaacaatgtggcattcggcgagggaccaagctgaccgtcctgggtcagcccaaggctgccccctcggtcactctgttcccaccctcctcttcgagcgt

SEQ ID NO: 562045 - DNA, 497 bp, Homo sapiens
  misc_feature: HIJSMM301BFT7T.2.49.E05.1.454.light.4.raw
acgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccgggcagagggtcaccatctcttgttctggaagcatgtccaacatcggaagtgataatgtatactggtaccagcagttcccaagagccggcccccaagctcctcatctatagaaattatgaacggtcctcaggggtccctgaccgattctctggctccaagtctggcacctcagcctccctggccatcagtgggctccggtccgaggatgaggctgattattactgtgttggatgggacagcagcctgagtgcttatgtcttcggaactgggaccacggtcaccgtcct

SEQ ID NO: 562046 - DNA, 494 bp, Homo sapiens; identical to SEQ ID NO: 534992
  misc_feature: HIJSMM301AVBDI.9.1.A01.1.454.light.4.raw

SEQ ID NO: 562047 - DNA, 494 bp, Homo sapiens; identical to SEQ ID NO: 535276
  misc_feature: HIJSMM301BODNY.16.6.A06.1.454.light.4.raw

SEQ ID NO: 562048 - DNA, 500 bp, Homo sapiens; identical to SEQ ID NO: 542309
  misc_feature: HIJSMM301CFCGA.12.86.H09.1.454.light.4.raw

SEQ ID NO: 562049 - DNA, 492 bp, Homo sapiens
  misc_feature: HIJSMM301DDZTV.51.59.F04.1.454.light.4.raw
cgatcgtatacacgaccggtgctcgatttagtacacacacttagggattggggggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcact

SEQ ID NO: 562050 - DNA, 494 bp, Homo sapiens
  misc_feature: HIJSMM301DMGQY.5.64.F09.1.454.light.4.raw
atcagacacgcacgaccggtgctcgatttagcgcgtatacaaggggcagactcagtcaggacacagcatggacatgagggtccccgctcagctcctggggctcctgctgctctggctcccaggtgccaaatgtgacatccaaatgacccagtctcctgccaccctgtctgcttttgtgggagacagaatcaccatcacttgccgggccagtcagactattagtacctggttggcctggtatcagcaaaaaccagggaaagcccctcgtctcctgatctttgatgcctccagtttagaaactggggtcccatcaaggttcagcggccgtggatctgggacagaattcactctcaccgtcaacggcctgcagcctgatgattttgcaacttattactgccatcagtatagtagttttccattcaccttcggccctgggaccaaagtggatctcagtcgaactgtggctgcaccatctgtcttcatcttcccgccta

SEQ ID NO: 562051 - DNA, 498 bp, Homo sapiens; identical to SEQ ID NO: 535295
  misc_feature: HIJSMM301E1EKY.15.25.C03.1.454.light.4.raw

SEQ ID NO: 562052 - DNA, 484 bp, Homo sapiens; identical to SEQ ID NO: 535240
  misc_feature: HIJSMM301BXCFL.47.60.F05.1.454.light.4.raw

SEQ ID NO: 562053 - DNA, 489 bp, Homo sapiens; identical to SEQ ID NO: 535139
  misc_feature: HIJSMM301AVHUC.14.55.E11.1.454.light.4.raw

SEQ ID NO: 562054 - DNA, 447 bp, Homo sapiens; identical to SEQ ID NO: 535020
  misc_feature: HIJSMM301A267E.18.9.A09.1.454.light.4.raw

SEQ ID NO: 562055 - DNA, 488 bp, Homo sapiens; identical to SEQ ID NO: 542699
  misc_feature: HIJSMM301ECB28.12.51.E07.1.454.light.4.raw

SEQ ID NO: 562056 - DNA, 498 bp, Homo sapiens; identical to SEQ ID NO: 535295
  misc_feature: HIJSMM301CO6SA.15.25.C03.1.454.light.4.raw

SEQ ID NO: 562057 - DNA, 460 bp, Homo sapiens; identical to SEQ ID NO: 536053
  misc_feature: HIJSMM301DJV7F.22.28.C06.1.454.light.4.raw

SEQ ID NO: 562058 - DNA, 512 bp, Homo sapiens; identical to SEQ ID NO: 548157
  misc_feature: HIJSMM301ANIZ9.17.33.C11.1.454.light.4.raw

SEQ ID NO: 562059 - DNA, 479 bp, Homo sapiens; identical to SEQ ID NO: 538734
  misc_feature: HIJSMM301EU4CB.8.53.E09.1.454.light.4.raw

SEQ ID NO: 562060 - DNA, 503 bp, Homo sapiens; identical to SEQ ID NO: 538884
  misc_feature: HIJSMM301DNDRT.27.78.H01.1.454.light.4.raw

SEQ ID NO: 562061 - DNA, 515 bp, Homo sapiens; identical to SEQ ID NO: 541898
  misc_feature: HIJSMM301BEQTY.16.66.F11.1.454.light.4.raw

SEQ ID NO: 562062 - DNA, 502 bp, Homo sapiens
  misc_feature: HIJSMM301ETKK1.10.65.F10.1.454.light.4.raw
catagtagtgcacgaccggtgctcgatttagctacgctctaagggggcaggagtcagtctcagtcaggacacagcatggacatgagggtccccgctcagctcctggggctcctgctactctggctccgaggtgccagatgtgacatccagatgacccagtctccaccgtccctgtctgcatttgttggagacagagtcaccatctcttgccggacaagtcagaacattgacacctatttgaattggtatcaacaaaaactggggaaagcccctacactcctgatcaatgcagcgtccagtttacagagtggggtcccctcaaggttcagtggcagtggatctgggacagactttactctcaccatcagcgatctgcagcctgacgattttgcgacttactactgtcaacagagtttccggaaccccgttactttcggcggagggaccaaggtggaggatcaaacgaactgtggctgcaccatctgtcttctactcttccccg

SEQ ID NO: 562063 - DNA, 484 bp, Homo sapiens; identical to SEQ ID NO: 535240
  misc_feature: HIJSMM301ENJNX.47.60.F05.1.454.light.4.raw

SEQ ID NO: 562064 - DNA, 480 bp, Homo sapiens
  misc_feature: HIJSMM301BU7V2.48.70.G04.1.454.light.4.raw
agtatacatacacgaccggtgctcgatttagtgtagtgtgaaggaaagggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttatcactatgtctcctggtaccaacagcaccctggcaaacgcccccaaactcatgatttatgatatcactaagcggccctcaggggtccctgatcgcttctctggctcccagtctggcaacacggcctccctgaccatctctgggctccaggctgaggatgaggctgattattactgctgctcatatgcaggcagctacactttggtgttcggcggagggaccaagctgactgtccctaggt

SEQ ID NO: 562065 - DNA, 507 bp, Homo sapiens; identical to SEQ ID NO: 535930
  misc_feature: HIJSMM301ASP11.15.34.D01.1.454.light.4.raw

SEQ ID NO: 562066 - DNA, 488 bp, Homo sapiens
  misc_feature: HIJSMM301APOBZ.4.24.C02.1.454.light.4.raw
agcactgtagcacgaccggtgctcgatttagtacagatcgttagggaaagggggagtcagactcagtcaggacacagcatggacatgagggtccccgctcagctcctggggctcctgctgctctggctcccaggtgccaaatgtgacgtccagatgacccagtctccttccaccctgtctgcatctataggagacagagtcaccatcacttgccgggccagtcagagtattagtaactggttggcctggtatcagcagaaaccaggcaaagccccaaaactccttatctctgatgcctccactttgcacggtggggtcccaccaacgttcagcggcagtgggtctgggacagaattcactctcaccatcagcagcctgcaacctgatgatgttgcaacttattactgtcaacaatataacagttattggacttcggccaagggaccaaggtggaatcagacgaactgtgctgcaccatctgtcttcta

SEQ ID NO: 562067 - DNA, 522 bp, Homo sapiens; identical to SEQ ID NO: 540226
  misc_feature: HIJSMM301DX0VK.27.23.C01.1.454.light.4.raw

SEQ ID NO: 562068 - DNA, 490 bp, Homo sapiens; identical to SEQ ID NO: 536481
  misc_feature: HIJSMM301AU0SX.13.46.E02.1.454.light.4.raw

SEQ ID NO: 562069 - DNA, 494 bp, Homo sapiens; identical to SEQ ID NO: 534992
  misc_feature: HIJSMM301DTG1U.9.1.A01.1.454.light.4.raw

SEQ ID NO: 562070 - DNA, 485 bp, Homo sapiens
  misc_feature: HIJSMM301BKG37.13.5.A05.1.454.light.4.raw
tcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccaacagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtggagatcaaacgaa

SEQ ID NO: 562071 - DNA, 517 bp, Homo sapiens
  misc_feature: HIJSMM301EG5KF.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagtgctacctcaccatctccagcctccagtctgaagatgaggctgactattactgtcagacatgggacgctggcgtctggctgttcggcggagggaccaagctgaccgtcctaggtcagcccaaggctgccccctggtcactctgttcccaccctcctcacg

SEQ ID NO: 562072 - DNA, 488 bp, Homo sapiens
  misc_feature: HIJSMM301E3U35.22.86.H09.1.454.light.4.raw
acatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgaccgtcctaggtcagcccaaggctgccccctggtcactctgttcccaccctcctc

SEQ ID NO: 562073 - DNA, 521 bp, Homo sapiens; identical to SEQ ID NO: 539470
  misc_feature: HIJSMM301ETBFA.27.23.C01.1.454.light.4.raw

SEQ ID NO: 562074 - DNA, 519 bp, Homo sapiens
  misc_feature: HIJSMM301B6UPG.27.23.C01.1.454.light.4.raw
agcgtcgtctcacgaccggtgctcgatttagtacacgtgattagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttccaccct

SEQ ID NO: 562075 - DNA, 498 bp, Homo sapiens
  misc_feature: HIJSMM301B5ZJ8.3.33.C11.1.454.light.4.raw
agacgcactccacgaccggtgctcgatttagagtgagctcgttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgcccccc

SEQ ID NO: 562076 - DNA, 493 bp, Homo sapiens
  misc_feature: HIJSMM301CV173.21.27.C05.1.454.light.4.raw
  modified_base (198)..(198): a, c, t, g, unknown or other
  modified_base (361)..(361): a, c, t, g, unknown or other
tcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttagcctggtaccagcagaaatctggccaggctcccaggctcctcatttaccgtgcatccaccagggccactggtgtcccagacaggttcagtggcggtggatttgggacagagttttcnctcaccatcagcgccctacagagtgaagatgttgcagtttatttctgccagcaatataattactggcctgcgtcgacgttcggccacgggaccaaggtggaatcaacgaactgtggctgcaccatctgtctt

SEQ ID NO: 562077 - DNA, 491 bp, Homo sapiens
  misc_feature: HIJSMM301B0C52.41.72.G06.1.454.light.4.raw
tctatactatcacgaccggtgctcgatttagctacgactgcaagggaaaggggtccaaacagagcttcagcaagcatagtgggaatctgcaccatgccctgggctctgctcctcctgaccctcctcactcactctgcagtgtcagtggtccaggcagggctgactcagccaacctcggtgtccgaggggttgggacagaccgccacactcacctgcactgggaacaacaacaatgttggtgaccaaggagcaacttggctgcagcagcaccagggccaccctcccaaactcctatcctacaggaataacaaccggccctcagggatctcagagagattctctgcatccaggtcaggaaacacagcctccctgaccattactggactccagcctgaggacgaggctgactattactgctcagcatgggacagcagcctcacaaattggatgttcggcggagggaccaagctgaccgtcctaggtcagcccaa

SEQ ID NO: 562078 - DNA, 488 bp, Homo sapiens
  misc_feature: HIJSMM301DAJC3.13.87.H10.1.454.light.4.raw
tcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagcaaaaaccagggaaagtccctaagctcctgatctatgttgcatccactttgcaaagtggggtcccatcaaggttcagcggcattggatctgggacagaattcactctcacaatcagcagcctgcagcctgaagattttgcaacttattactgtcaacagcttaatagttacccgctcagtttcggcggagggaccaaggtggagatcaaacgaactgtggctgcaccatctgtt

SEQ ID NO: 562079 - DNA, 486 bp, Homo sapiens; identical to SEQ ID NO: 535523
  misc_feature: HIJSMM301BJ8Z8.22.73.G07.1.454.light.4.raw

SEQ ID NO: 562080 - DNA, 505 bp, Homo sapiens; identical to SEQ ID NO: 535503
  misc_feature: HIJSMM301CDQC7.8.28.C06.1.454.light.4.raw

SEQ ID NO: 562081 - DNA, 486 bp, Homo sapiens; identical to SEQ ID NO: 535290
  misc_feature: HIJSMM301DHX8F.3.12.B01.1.454.light.4.raw

SEQ ID NO: 562082 - DNA, 489 bp, Homo sapiens
  misc_feature: HIJSMM301DM55P.51.80.H03.1.454.light.4.raw
cgatcgtatacacgaccggtgctcgatttagctgtgcgtcgaaggagggagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaactcatgatttatgaggtcagtaagcggccctcaggggtccctgatcgcttctctggctccaagtctggcaacacggcctccctgaccgtctctgggctccaggctgaggatgaggctgattattactgctgctcacatgcaggcagcatcggtgtgctattcggcggagggaccaagctgaccgtcctaggtcagcccaaggctgccccctcggtcact

SEQ ID NO: 562083 - DNA, 487 bp, Homo sapiens
  misc_feature: HIJSMM301E1OF3.5.59.F04.1.454.light.4.raw
atcagacacgcacgaccggtgctcgatttagtacacacacttagggattggggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagccctaagctcctgatctatgctgcatccagtttacaaagtggggtcccatcaaggttcagtggcagtggatctgggacagatttcactctcaccatcagtagtctacaacctgaagattttgcaacttactactgtcaacagagttacgatacccctccgctcactttcggcggagggaccaaggtggagatcaaacgaactgtggctgcaccat

SEQ ID NO: 562084 - DNA, 511 bp, Homo sapiens
  misc_feature: HIJSMM301BPUD5.19.78.H01.1.454.light.4.raw
  modified_base (444)..(444): a, c, t, g, unknown or other
tactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcagtcgtatctcttatntcgttcgtacgaggtacgaacgacgtcctccgtacgtcgtcaccgaccgacgaccccaacctgtcta

SEQ ID NO: 562085 - DNA, 499 bp, Homo sapiens
  misc_feature: HIJSMM301D8V31.13.19.B08.1.454.light.4.raw
tcacgtactacacgaccggtgctcgatttagtgagtcagtaagggggtaggctcaggaggcagagctctgaatgtctcaccatggcctggatccctctcctgctccccctcctcattctctgcacagtctctgtgacctcctatgaactgacacagccatcctcagtgtcagtgtctccgggacagacggccaggatcacctgctcaggaaatattctgacaaaaaaatatgctcggtggttccagcagaagccaggccaggccccagtactggtgatttataaagacattgagcggccctcagggatccctgagcgattctccggctctaattcagggaccacagtcaccttgaccatcaccggggcccagattgaggatgaggctgactattactgtcaggcgtgggacagcagcactgcctccttcggaactgggaccaaggtcaccgtcctaggtcagcccaaggccaaccccactgtcactctgttcccaccct

SEQ ID NO: 562086 - DNA, 380 bp, Homo sapiens; identical to SEQ ID NO: 540540
  misc_feature: HIJSMM301BD7SI.12.78.H01.1.454.light.4.raw

SEQ ID NO: 562087 - DNA, 494 bp, Homo sapiens
  misc_feature: HIJSMM301DKMY2.15.66.F11.1.454.light.4.raw
  modified_base (408)..(408): a, c, t, g, unknown or other
  modified_base (475)..(475): a, c, t, g, unknown or other
  modified_base (491)..(491): a, c, t, g, unknown or other
tctacgtagccacgaccggtgctcgatttagtcacgcgagaagggggggtctcgaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaagccccaaagtcatcatttatgagctcactaagcggccctcaggggtccctgatcgcttctctggctccaagtctggcgactcggcctccctgaccgtctctgggctccagcctgaagatgaggctgattatttctgcgctcatntggagacaattacagctttgcttcggaagtgggaccaaggtcacgtcagtcagccaaggccaacccnctgcactctgttcccncct

SEQ ID NO: 562088 - DNA, 490 bp, Homo sapiens; identical to SEQ ID NO: 551019
  misc_feature: HIJSMM301EWWY7.48.37.D04.1.454.light.4.raw

SEQ ID NO: 562089 - DNA, 498 bp, Homo sapiens; identical to SEQ ID NO: 536173
  misc_feature: HIJSMM301B6BCA.12.86.H09.1.454.light.4.raw

SEQ ID NO: 562090 - DNA, 498 bp, Homo sapiens; identical to SEQ ID NO: 537020
  misc_feature: HIJSMM301CIUSU.26.26.C04.1.454.light.4.raw

SEQ ID NO: 562091 - DNA, 491 bp, Homo sapiens; identical to SEQ ID NO: 535176
  misc_feature: HIJSMM301CYM6Q.13.39.D06.1.454.light.4.raw

SEQ ID NO: 562092 - DNA, 493 bp, Homo sapiens; identical to SEQ ID NO: 535657
  misc_feature: HIJSMM301CZQXZ.27.78.H01.1.454.light.4.raw

SEQ ID NO: 562093 - DNA, 501 bp, Homo sapiens; identical to SEQ ID NO: 536142
  misc_feature: HIJSMM301CG7SQ.15.1.A01.1.454.light.4.raw

SEQ ID NO: 562094 - DNA, 505 bp, Homo sapiens; identical to SEQ ID NO: 540772
  misc_feature: HIJSMM301DOK6F.5.24.C02.1.454.light.4.raw

SEQ ID NO: 562095 - DNA, 485 bp, Homo sapiens; identical to SEQ ID NO: 560039
  misc_feature: HIJSMM301DI6YL.41.54.E10.1.454.light.4.raw

SEQ ID NO: 562096 - DNA, 509 bp, Homo sapiens
  misc_feature: HIJSMM301CA9QO.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaactcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcgtccacggaccgaacggtaggaaagtacaagacgaactagtggctgcaccatctgtcttctactcttcccgt

SEQ ID NO: 562097 - DNA, 444 bp, Homo sapiens; identical to SEQ ID NO: 534993
  misc_feature: HIJSMM301AFYMW.5.9.A09.1.454.light.4.raw

SEQ ID NO: 562098 - DNA, 495 bp, Homo sapiens
  misc_feature: HIJSMM301C96VQ.3.31.C09.1.454.light.4.raw
agacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcaactacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgctagtttattactgtcagcagcgtagcaactggcctctcactttcggcggaggaccaaggtggagatcaaacgaactgtggctgcaccatctgtctt

SEQ ID NO: 562099 - DNA, 504 bp, Homo sapiens; identical to SEQ ID NO: 537776
  misc_feature: HIJSMM301BNHD9.8.71.G05.1.454.light.4.raw

SEQ ID NO: 562100 - DNA, 444 bp, Homo sapiens; identical to SEQ ID NO: 535027
  misc_feature: HIJSMM301BFNO7.8.73.G07.1.454.light.4.raw

SEQ ID NO: 562101 - DNA, 444 bp, Homo sapiens
  misc_feature: HIJSMM301EEBCM.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctgccccctcggtcactctcgtcccgccctcctccgtgtctgat

SEQ ID NO: 562102 - DNA, 494 bp, Homo sapiens
  misc_feature: HIJSMM301AKUHO.10.79.H02.1.454.light.4.raw
catagtagtgcacgaccggtgctcgatttagtgtcacacgaagggaaaggggaagagctgctcagttaggacccagagggaaccatggaaaccccagcgcagcttctcttcctcctgctactctgactcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggccaggggaccaagctggagatcaaacgaactgtggctgcaccatctgtctt

SEQ ID NO: 562103 - DNA, 475 bp, Homo sapiens
  misc_feature: HIJSMM301B9OAL.13.76.G10.1.454.light.4.raw
tcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcaccgtcctaagtcagacccg

SEQ ID NO: 562104 - DNA, 489 bp, Homo sapiens; identical to SEQ ID NO: 544280
  misc_feature: HIJSMM301EMOUA.4.27.C05.1.454.light.4.raw

SEQ ID NO: 562105 - DNA, 519 bp, Homo sapiens
  misc_feature: HIJSMM301EK2P6.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagccaaggctgccccctcggtcactctgttcccgcct

SEQ ID NO: 562106 - DNA, 503 bp, Homo sapiens; identical to SEQ ID NO: 550542
  misc_feature: HIJSMM301A4SGP.2.76.G10.1.454.light.4.raw

SEQ ID NO: 562107 - DNA, 491 bp, Homo sapiens; identical to SEQ ID NO: 538388
  misc_feature: HIJSMM301AL6LP.51.81.H04.1.454.light.4.raw

SEQ ID NO: 562108 - DNA, 497 bp, Homo sapiens
  misc_feature: HIJSMM301AELB6.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggccgtccggggtccctgacaggttcagtggcagtggatcaggcacagattttacgctagaaaatcagtagggtggaggctgaggatggttgggtttagttactgcatgcagttctactaacttacctactactttggtccgacgggaccgaagactggagatacaacgaacta

SEQ ID NO: 562109 - DNA, 484 bp, Homo sapiens; identical to SEQ ID NO: 535400
  misc_feature: HIJSMM301CI611.46.26.C04.1.454.light.4.raw

SEQ ID NO: 562110 - DNA, 501 bp, Homo sapiens; identical to SEQ ID NO: 535746
  misc_feature: HIJSMM301DA8TR.18.11.A11.1.454.light.4.raw

SEQ ID NO: 562111 - DNA, 513 bp, Homo sapiens; identical to SEQ ID NO: 535244
  misc_feature: HIJSMM301BXTBF.17.33.C11.1.454.light.4.raw

SEQ ID NO: 562112 - DNA, 494 bp, Homo sapiens
  misc_feature: HIJSMM301BHWTY.10.37.D04.1.454.light.4.raw
catagtagtgcacgaccggtgctcgatttagtagcatactgttgggtttgggggctctggggaggaactgctcagttaggacccagacggaaccatggaagccccagcgcagcttctcttcctcctgctactctggctcccagattccactggagaaatagttttgacgcaatctccagccaccctgtctgtgactccaggtgagagagccaccctctcttgcagggccagtcaggggatcagcagcaatttagcctggtaccaacagaagcctggccaggttcccagactcctcatatatgaagcctcttccagggccactggagtcccagccaggttcagcggcggtgggtctgggacagacttcactctcaccatcagcagcctgcagtctgaggaccttggagtttattactgtcagcagtatcataactggcctcgtggacgttcggccaaggaccaaggtggactcaaacgaactgtggctgcaccat

SEQ ID NO: 562113 - DNA, 497 bp, Homo sapiens; identical to SEQ ID NO: 535664
  misc_feature: HIJSMM301DW87N.22.14.B03.1.454.light.4.raw

SEQ ID NO: 562114 - DNA, 482 bp, Homo sapiens
  misc_feature: HIJSMM301CRQCK.53.85.H08.1.454.light.4.raw
  modified_base (454)..(454): a, c, t, g, unknown or other
cgcgtatacacacgaccggtgctcgatttagtatcactcagtcgcgggggcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcacgttatgatgtacactggtaccagcaccttccaggagcagcccccggaacctcctcctctctggtaacaccaatcggccctcaggggtccctgaccgattctctggctcgaagtctggcacctcagcctccctggccatcactggcctccaggctgaggatgaggctgattattactgccagtcctatgacagcagcctgaatgcttangtcttcggaactgggaccaaggtcaccg

SEQ ID NO: 562115 - DNA, 523 bp, Homo sapiens
  misc_feature: HIJSMM301CMIAP.27.23.C01.1.454.light.4.raw
agcgtcgtctcacgaccggtgctcgatttagtacacgtgattagggattggggggggtctcaggaggcagcgctctcgggacgtctccaccatggcctgggctctgctattccccaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccacctcct

SEQ ID NO: 562116 - DNA, 496 bp, Homo sapiens
  misc_feature: HIJSMM301C2ZUB.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactcccaccatcagcagcctgcaggctgaagatgtggcagtttattattgtcagcaatattatattcctcctcagacgttcggccaagggaccaaggtggaaatcaaacgaactgtggctgcacc

SEQ ID NO: 562117 - DNA, 493 bp, Homo sapiens
  misc_feature: HIJSMM301EG6EW.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccgggtgggggctggaggatgttggcatttattacttgcatgcaggctatacacctttcctgcctacttttggccaggggaccaagctggagatcaggcgtaacg

SEQ ID NO: 562118 - DNA, 515 bp, Homo sapiens
  misc_feature: HIJSMM301D5BMG.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggccgtccgggggccactttccggcccgtcgggaccgaaagtaggatatacaaacgaactgtggctgcaccatctgtcttcta

SEQ ID NO: 562119 - DNA, 520 bp, Homo sapiens; identical to SEQ ID NO: 558856
  misc_feature: HIJSMM301EHIK4.12.71.G05.1.454.light.4.raw

SEQ ID NO: 562120 - DNA, 494 bp, Homo sapiens; identical to SEQ ID NO: 534994
  misc_feature: HIJSMM301EE5OV.27.78.H01.1.454.light.4.raw

SEQ ID NO: 562121 - DNA, 490 bp, Homo sapiens; identical to SEQ ID NO: 541567
  misc_feature: HIJSMM301E0ATN.22.65.F10.1.454.light.4.raw

SEQ ID NO: 562122 - DNA, 501 bp, Homo sapiens
  misc_feature: HIJSMM301C9BBD.9.81.H04.1.454.light.4.raw
tgatacgtctcacgaccggtgctcgatttagtagtgtagattcgcgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtgcttataactatgtctcctggtaccaacagcacccaggcaaagtccccaaactcatgatttatgaggtcaataagcggccctctggggtccctgatcgcttctctggctccaagtctggcaacacggcctccctgaccgtctctgggctccaggctgacgatgaggctgattattactgcagctcatatgcaggcacccacaatgtcttcggaagtgggaccacggtcaccgtcctaggtcagcccaaggccaaccccactgtcactt

SEQ ID NO: 562123 - DNA, 494 bp, Homo sapiens; identical to SEQ ID NO: 537607
  misc_feature: HIJSMM301D43D2.52.10.A10.1.454.light.4.raw

SEQ ID NO: 562124 - DNA, 496 bp, Homo sapiens; identical to SEQ ID NO: 536248
  misc_feature: HIJSMM301EIBZX.22.27.C05.1.454.light.4.raw

SEQ ID NO: 562125 - DNA, 513 bp, Homo sapiens; identical to SEQ ID NO: 535719
  misc_feature: HIJSMM301A6VKH.17.33.C11.1.454.light.4.raw

SEQ ID NO: 562126 - DNA, 504 bp, Homo sapiens
  misc_feature: HIJSMM301A954H.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttgccaagggaccgaaggtggaaagtcaaacgaactagtggctgcaccactctgtcttcatcttccccg

SEQ ID NO: 562127 - DNA, 444 bp, Homo sapiens
  misc_feature: HIJSMM301B0QWR.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctgccccctcggtcactctgttctcaccctcctccgtgtctgat

SEQ ID NO: 562128 - DNA, 512 bp, Homo sapiens
  misc_feature: HIJSMM301BRX0Q.17.33.C11.1.454.light.4.raw
  modified_base (506)..(506): a, c, t, g, unknown or other
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccncctcct

SEQ ID NO: 562129 - DNA, 518 bp, Homo sapiens
  misc_feature: HIJSMM301A8D2C.5.27.C05.1.454.light.4.raw
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactcgtcactctgttcccaccctcctccgt

SEQ ID NO: 562130 - DNA, 490 bp, Homo sapiens
  misc_feature: HIJSMM301EKSWW.51.81.H04.1.454.light.4.raw
cgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagccaaggccaacccactgtcact

SEQ ID NO: 562131 - DNA, 484 bp, Homo sapiens; identical to SEQ ID NO: 535400
  misc_feature: HIJSMM301CIBAZ.46.26.C04.1.454.light.4.raw

SEQ ID NO: 562132 - DNA, 489 bp, Homo sapiens; identical to SEQ ID NO: 554625
  misc_feature: HIJSMM301CMNAB.46.35.D02.1.454.light.4.raw

SEQ ID NO: 562133 - DNA, 492 bp, Homo sapiens
  misc_feature: HIJSMM301EOC29.51.71.G05.1.454.light.4.raw
cgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtctgggtcagcccaaggccaaccccatgtca

SEQ ID NO: 562134 - DNA, 514 bp, Homo sapiens; identical to SEQ ID NO: 554424
  misc_feature: HIJSMM301AXFGQ.15.76.G10.1.454.light.4.raw

SEQ ID NO: 562135 - DNA, 498 bp, Homo sapiens
  misc_feature: HIJSMM301EY81D.19.85.H08.1.454.light.4.raw
tactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggaggaccaagctgaccgtctgggtcagccaagctgcccctcggt

SEQ ID NO: 562136 - DNA, 496 bp, Homo sapiens
  misc_feature: HIJSMM301DOIS1.16.46.E02.1.454.light.4.raw
tgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatactttgtcttcggaactggaccaaggtcaccgtcctaggtcagcccaaggccaaccccactgtcactctcgttcccaccctcctcgagtagtaca

SEQ ID NO: 562137 - DNA, 472 bp, Homo sapiens
  misc_feature: HIJSMM301DFA0X.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctcctccgagtgccacttttggcggggggaccaaggtggagatcaaacgaa

SEQ ID NO: 562138 - DNA, 476 bp, Homo sapiens
  misc_feature: HIJSMM301AFQEG.40.10.A10.1.454.light.4.raw
tctagcgactcacgaccggtgctcgatttagcgtcgatctcagggggcaggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagcggcagtggatctggcacagagttcactctcaccatcagcaccctgcagcctgaagattttgcgacttatttctgtctacaagattctaattaccctcggacgttcggccagggaccgaaagtaggatgtcaaccgaactgtggctg

SEQ ID NO: 562139 - DNA, 485 bp, Homo sapiens
  misc_feature: HIJSMM301D3G22.26.78.H01.1.454.light.4.raw
agactatactcacgaccggtgctcgatttagtgtgagtagtttgggtttggggcagagccctggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcgggcggagggaccaggggtggagatcagacgaa

SEQ ID NO: 562140 - DNA, 446 bp, Homo sapiens; identical to SEQ ID NO: 539491
  misc_feature: HIJSMM301DRIEQ.18.9.A09.1.454.light.4.raw

SEQ ID NO: 562141 - DNA, 498 bp, Homo sapiens; identical to SEQ ID NO: 537020
  misc_feature: HIJSMM301EIV7T.26.26.C04.1.454.light.4.raw

SEQ ID NO: 562142 - DNA, 447 bp, Homo sapiens; identical to SEQ ID NO: 535201
  misc_feature: HIJSMM301EIX8E.18.9.A09.1.454.light.4.raw

SEQ ID NO: 562143 - DNA, 507 bp, Homo sapiens
  misc_feature: HIJSMM301CWO7Z.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaagtggatatcaaacgaactgtggctgcaccatctgtcttta

SEQ ID NO: 562144 - DNA, 486 bp, Homo sapiens; identical to SEQ ID NO: 535043
  misc_feature: HIJSMM301BEFNE.46.35.D02.1.454.light.4.raw

SEQ ID NO: 562145 - DNA, 514 bp, Homo sapiens
  misc_feature: HIJSMM301EG8E1.16.1.A01.1.454.light.4.raw
tgtactactccacgaccggtgctcgatttagacgtctcatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaccaagctggccgtcctaggtcagcccaaggctgccccctcggtcactctgttccccg

SEQ ID NO: 562146 - DNA, 490 bp, Homo sapiens; identical to SEQ ID NO: 542820
  misc_feature: HIJSMM301B8019.11.12.B01.1.454.light.4.raw

SEQ ID NO: 562147 - DNA, 501 bp, Homo sapiens; identical to SEQ ID NO: 536142
  misc_feature: HIJSMM301CAT8E.15.1.A01.1.454.light.4.raw

SEQ ID NO: 562148 - DNA, 478 bp, Homo sapiens
  misc_feature: HIJSMM301D3V63.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactaccctctcactttcgcgggggaccaaggtggagatcaaacgaactgtgctgcaca

SEQ ID NO: 562149 - DNA, 488 bp, Homo sapiens
  misc_feature: HIJSMM301D0UZP.12.51.E07.1.454.light.4.raw
atacgacgtacacgaccggtgctcgatttagcatactctacaacacacaaaggggcaggagtcagacccagtcaggacacagcatggacatgagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtggggtcccatcaaggttcagcggcagtgggtctgggacagaattcactctcaccatcagcagcctgcaacctgatgactttgcaacttattactgccaacagtataatggttatgaatccacttttggccaagggaccaagctggagatcaaacgaactgtggctgcacca

SEQ ID NO: 562150 - DNA, 510 bp, Homo sapiens
  misc_feature: HIJSMM301BQLNN.17.28.C06.1.454.light.4.raw
cgtagactagcacgaccggtgctcgatttagagctcacgtattgggtttggggagcttcagctgtggtagagaagacaggattcaggacaatctccagcatggccggcttccttctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggcctgccccctc

SEQ ID NO: 562151 - DNA, 511 bp, Homo sapiens
  misc_feature: HIJSMM301E1BLV.12.21.B10.1.454.light.4.raw
atacgacgtacacgaccggtgctcgatttagtgtcgtcgcaagagaggagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaagctgaccgtcctgggtcagcccaaggctgccccctcggt

SEQ ID NO: 562152 - DNA, 478 bp, Homo sapiens
  misc_feature: HIJSMM301AOJTQ.49.27.C05.1.454.light.4.raw
agtcgagagacacgaccggtgctcgatttagacgcgatcgaagggtttgggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctccgctcactttcggcgggggaccgaaggtggagatcaagcgaactgtggctgcaccta

SEQ ID NO: 562153 - DNA, 485 bp, Homo sapiens; identical to SEQ ID NO: 535501
  misc_feature: HIJSMM301DK6FE.3.10.A10.1.454.light.4.raw

SEQ ID NO: 562154 - DNA, 486 bp, Homo sapiens; identical to SEQ ID NO: 535043
  misc_feature: HIJSMM301AU4BT.46.35.D02.1.454.light.4.raw

SEQ ID NO: 562155 - DNA, 506 bp, Homo sapiens
  misc_feature: HIJSMM301ELRO5.18.26.C04.1.454.light.4.raw
tacgagtatgcacgaccggtgctcgatttagtctagcgactttgggtttggggggtcgagacccacgtcgggacacagcatggacatgagggtccccgcctcagctcctggggcgtcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaagcccctaagctgcagatgattggtccgtccagtttccaagatggggccccatcgagattccgcgtcagtggatctgggacagatttcactctcaccatcagcagcctgcagcctgaagattttgcaacttactattgtcagcaggcgcacaatttcccgctcactttcggcggagggaccaaggtggagatcaaacgaactgtggctgcaccatctgtcttcatcttccccgc

SEQ ID NO: 562156 - DNA, 502 bp, Homo sapiens
  misc_feature: HIJSMM301DBNBB.10.71.G05.1.454.light.4.raw
catagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccaaaatagaggtcaaacgaactagtggctgcaccatctgtcttcat

SEQ ID NO: 562157 - DNA, 479 bp, Homo sapiens; identical to SEQ ID NO: 538204
  misc_feature: HIJSMM301BALFE.51.60.F05.1.454.light.4.raw

SEQ ID NO: 562158 - DNA, 509 bp, Homo sapiens
  misc_feature: HIJSMM301C90KL.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggtccaagggaccaaggtaggaaagtacaaacgaactagtggctgcaccatctgtcttcctatcttccccg

SEQ ID NO: 562159 - DNA, 516 bp, Homo sapiens
  misc_feature: HIJSMM301BCGVG.8.23.C01.1.454.light.4.raw
ctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctggtggggggttcaatattggaggtaacaatgtgcactggtaccagcagaaggcagggcaggcccctgtactggtcatctatgggggatccatccggccaggtgggacccctgcgcgattctctgcctccatctcggggaacgcggccaccctgaccatcagcaaagcccaagccggtgatgaggctgactatttttgtcaggtgtgggacagcagcatttatgtcttcggacctgggaccaaggtcaccgtcctaggtcagcccaaggccaaccccactcgtcactctgttcccgccctcctcga

SEQ ID NO: 562160 - DNA, 495 bp, Homo sapiens; identical to SEQ ID NO: 538269
  misc_feature: HIJSMM301ANCYO.9.1.A01.1.454.light.4.raw

SEQ ID NO: 562161 - DNA, 416 bp, Homo sapiens; identical to SEQ ID NO: 536892
  misc_feature: HIJSMM301CBD28.16.46.E02.1.454.light.4.raw

SEQ ID NO: 562162 - DNA, 486 bp, Homo sapiens; identical to SEQ ID NO: 535043
  misc_feature: HIJSMM301EKUY2.46.35.D02.1.454.light.4.raw

SEQ ID NO: 562163 - DNA, 488 bp, Homo sapiens; identical to SEQ ID NO: 537260
  misc_feature: HIJSMM301D8PWW.47.70.G04.1.454.light.4.raw

SEQ ID NO: 562164 - DNA, 486 bp, Homo sapiens
  misc_feature: HIJSMM301AOK1Z.46.13.B02.1.454.light.4.raw
actagcagtacacgaccggtgctcgatttagtctagcgactttaggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggtcggagggaccgaaggtggagatcaaacgaa

SEQ ID NO: 562165 - DNA, 512 bp, Homo sapiens; identical to SEQ ID NO: 557995
  misc_feature: HIJSMM301CE70D.17.33.C11.1.454.light.4.raw

SEQ ID NO: 562166 - DNA, 493 bp, Homo sapiens
  misc_feature: HIJSMM301C0P4F.22.86.H09.1.454.light.4.raw
acatacgcgtcacgaccggtgctcgatttagtgctatagacttgggtttggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgaccgtcctaggtcagcccaaggctgccccctcggtcactctgttcccgcctcctcacgtcg

SEQ ID NO: 562167 - DNA, 485 bp, Homo sapiens; identical to SEQ ID NO: 535606
  misc_feature: HIJSMM301EQQSV.47.46.E02.1.454.light.4.raw

SEQ ID NO: 562168 - DNA, 506 bp, Homo sapiens; identical to SEQ ID NO: 537290
  misc_feature: HIJSMM301DPEK1.13.11.A11.1.454.light.4.raw

SEQ ID NO: 562169 - DNA, 494 bp, Homo sapiens
  misc_feature: HIJSMM301EWOKS.22.86.H09.1.454.light.4.raw
acatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaacaacagcacccaggcaaagcccccagactcatcatttatgctgtcaataagcggcctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgaccgtcctaggtcagcccaaggctgccccctcggtcactctgttcccacctcct

SEQ ID NO: 562170 - DNA, 482 bp, Homo sapiens
  misc_feature: HIJSMM301BXGOO.10.4.A04.1.454.light.4.raw
catagtagtgcacgaccggtgctcgatttagagtagtgatcaggggctgggcctcaggaagcagcatcggaggtgcctcagccatggcatggatccctctcttcctcggcgtccttgcttactgcacagcatccgtggcctcctctgacctgactcagccaccctcactgtccgtgtcgccaggagagacagccaccattacatgctctggagaagcgttgagcgataaatttgtttcgtggtataaacagaagtcaggccagtcgcctgtgttggtcatctatcaaaatattaagcggccctcaggggtccctgagcgaatctctggcgccaagtctgggaccacaggcacgctgaccatcagtgtgacccaggctgtggatgaggcagactattactgtcaggcgtgggacagtagcgctgtgattttcggcggagggaccaagctgaccgtcctaggtcagcccaaggctgccccctcc

SEQ ID NO: 562171 - DNA, 494 bp, Homo sapiens; identical to SEQ ID NO: 535629
  misc_feature: HIJSMM301CIQRN.4.27.C05.1.454.light.4.raw

SEQ ID NO: 562172 - DNA, 498 bp, Homo sapiens; identical to SEQ ID NO: 550538
  misc_feature: HIJSMM301DYWFU.52.29.C07.1.454.light.4.raw

SEQ ID NO: 562173 - DNA, 463 bp, Homo sapiens
  misc_feature: HIJSMM301ALYQR.18.59.F04.1.454.light.4.raw
tacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcacgtcctaggtcagcccaaggccaaccccactgtcactctgttcccaccctcctccatactcgta

SEQ ID NO: 562174 - DNA, 495 bp, Homo sapiens; identical to SEQ ID NO: 536359
  misc_feature: HIJSMM301BKF1O.48.4.A04.1.454.light.4.raw

SEQ ID NO: 562175 - DNA, 493 bp, Homo sapiens; identical to SEQ ID NO: 535745
  misc_feature: HIJSMM301AW1TG.47.78.H01.1.454.light.4.raw

SEQ ID NO: 562176 - DNA, 498 bp, Homo sapiens
  misc_feature: HIJSMM301DUT4G.47.70.G04.1.454.light.4.raw
  modified_base (482)..(482): a, c, t, g, unknown or other
agctcacgtacacgaccggtgctcgatttagtgtagtgtgaagggaaagggggagtcagtcgtcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctagaagtatttgcaacttactactgtacaacagtagttaccggtaccccgtactacgttttggccgaggggaccaaactggacataccaaacgaactgnggctgccacatctgtt

SEQ ID NO: 562177 - DNA, 499 bp, Homo sapiens
  misc_feature: HIJSMM301CG8RQ.9.53.E09.1.454.light.4.raw
tgatacgtctcacgaccggtgctcgatttagagagagtgtgttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcaaatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggaccaaggtgaccgtcctaggtcagcccaaggcctgccccctc

SEQ ID NO: 562178 - DNA, 493 bp, Homo sapiens
  misc_feature: HIJSMM301AVFCJ.49.69.G03.1.454.light.4.raw
agtcgagagacacgaccggtgctcgatttagtcgctgcgtaaaggagaaagggggaggaactgctcagttaggacccagagggaaccatggaagccccagctcagcttctcttcctcctgcttctctggctcccagatattaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgggacagacttcactctcaccatcagcagcctagagcctgaagattttgcagtctattactgtcagcagcgttacaactggcctcccatgtacacttttggccaggggaccaagctggaaatcagacgaactgtggctgcaccat

SEQ ID NO: 562179 - DNA, 490 bp, Homo sapiens
  misc_feature: HIJSMM301CN584.12.31.C09.1.454.light.4.raw
atacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctccctgtctgcatctgtaggagacaaagtcaccatcacttgccgggctaacgagagtattgccacgtatttaaattggtatcaacaaaagcaggcaaagtcccaaagctcctgatttatgctgccaccagtctgcaaggtgggttcccgtcaaggttcactggccgtggatcagggacagaatttactctcaccatcagtagtctacagcctgaagatattgctacttattactgtcagcagagttaccgcgctcccatcactttcggccaagggacacgaccgcaggaatttgggaaccgaaaccgttggtt

SEQ ID NO: 562180 - DNA, 488 bp, Homo sapiens; identical to SEQ ID NO: 535861
  misc_feature: HIJSMM301B29YJ.14.55.E11.1.454.light.4.raw

SEQ ID NO: 562181 - DNA, 491 bp, Homo sapiens
  misc_feature: HIJSMM301CLS6T.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcaggggacaggatttcacactgaaaatcagccgggtgggggctgaggatgttggcatttattactgcatgcaggctatacaccttcctgccacttttggccaggggaccaagctggagatcaggcgtaacg

SEQ ID NO: 562182 - DNA, 490 bp, Homo sapiens
  misc_feature: HIJSMM301CMI6Z.14.28.C06.1.454.light.4.raw
cgtctagtaccacgaccggtgctcgatttagagctcacgtattgggtttgggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtggaggtcaaacgaactgtgctgcaccatctgtcttcta

SEQ ID NO: 562183 - DNA, 493 bp, Homo sapiens; identical to SEQ ID NO: 535084
  misc_feature: HIJSMM301CH3TC.47.64.F09.1.454.light.4.raw

SEQ ID NO: 562184 - DNA, 481 bp, Homo sapiens
  misc_feature: HIJSMM301BVWX4.5.12.B01.1.454.light.4.raw
atcagacacgcacgaccggtgctcgatttagtagtgtagattccgcggggggcccactgttagggctcaggggctgtgtccaccatggcctggactcttctccttctcgtgctcctctctcactgcacaggttccctctcccagcctgtgctgactcagccatcttcccattctgcatcttctggagcatcagtcagactcacctgcatgctgagcagtggcttcagtgttggggacttctggataaggatatcagaggctgattgcagagtcaccttatagatcacttcatagacacagggaacagaagacacagacaactgaggaagcaaagtttaaattctactcacgtttgatttccaccttggtcccttggccgaacgtcctcgggtgttcggcggagggaccaagctgaccgtcctaggtcagcccaaggctgccccctcggtcactctcgttcccgccctcctccgtgtctgat

SEQ ID NO: 562185 - DNA, 504 bp, Homo sapiens
  misc_feature: HIJSMM301EQ9YC.48.35.D02.1.454.light.4.raw
agtatacatacacgaccggtgctcgatttagcacacgatagttgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcaccatctgtcttcatcttccccg

SEQ ID NO: 562186 - DNA, 500 bp, Homo sapiens
  misc_feature: HIJSMM301EP3CF.43.3.A03.1.454.light.4.raw
tgtgagtagtcacgaccggtgctcgatttagagagcgtcacagggggtggtagctcaggaagcagagcctggagcatctccactatggcctgggctccactacttctcaccctcctcgctcactgcacaggttcttgggccagttttatgctgactcagccccactctgtgtcggagtctccggggaagacggtaaccatctcctgcacccgcagcggtggctttattgccagcaataatatgcagtggtaccagcagcgcccgggcagtccccccaccactgtgatctatgaggatgaccaaagaccctctgaggtccctaatcggttctctggctccgtcgacacctcctccaactctgcctacctcaccatctctggactgaagactgaggacgaggctgactattactgtcactcttatgatcgcaacaacagggtgttcggcggagggaccaggttgaccgtccttggtcagcccaaggctgccccctggtcact

SEQ ID NO: 562187 - DNA, 520 bp, Homo sapiens; identical to SEQ ID NO: 540016
  misc_feature: HIJSMM301BCRPZ.41.19.B08.1.454.light.4.raw
  modified_base (513)..(513): a, c, t, g, unknown or other

SEQ ID NO: 562188 - DNA, 514 bp, Homo sapiens; identical to SEQ ID NO: 545978
  misc_feature: HIJSMM301C2MIZ.17.33.C11.1.454.light.4.raw

SEQ ID NO: 562189 - DNA, 490 bp, Homo sapiens
  misc_feature: HIJSMM301BF6VO.21.27.C05.1.454.light.4.raw
  modified_base (199)..(199): a, c, t, g, unknown or other
tcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatctggccaggctcccaggctcctcatttaccgtgcatccactagggccactggtgtcccagacaggttcagtggcggtggatttgggacagagttttctctcaccatcagcgccctacagagtgaagatgttgcagtttatttctgccagcaatataattactggcctgcgtcgacgttcggcacggacaaggtggaatcaacgaactgtggctgcacatctgtctt

SEQ ID NO: 562190 - DNA, 489 bp, Homo sapiens; identical to SEQ ID NO: 542780
  misc_feature: HIJSMM301A0VJZ.16.53.E09.1.454.light.4.raw

SEQ ID NO: 562191 - DNA, 441 bp, Homo sapiens; identical to SEQ ID NO: 534971
  misc_feature: HIJSMM301DV1VB.11.3.A03.1.454.light.4.raw

SEQ ID NO: 562192 - DNA, 509 bp, Homo sapiens; identical to SEQ ID NO: 539359
  misc_feature: HIJSMM301BBCZS.47.85.H08.1.454.light.4.raw

SEQ ID NO: 562193 - DNA, 492 bp, Homo sapiens
  misc_feature: HIJSMM301ENVYC.11.71.G05.1.454.light.4.raw
cgagagataccacgaccggtgctcgatttagtgtcgtcgcaagagagagggggaggaactgctcagttaggacccagagggaaccatggaagccccagctcagcttctcttcctcctgctactctggctcccagatagcaccggagaaattgtgttgacacagtctccagccaccctgtctttgtctccaggggaaagagccaccctctcctgcagggccagtcagagtgttaacagctacttagcctggtaccaacagaaacctggccagactcccaggctcctcatctatgatgcatccaacagggccactggcaccccagccaggttcagtggcagtgggtctgggacagacttcactctcaccatcagcagcctagagcctgaggattttgcagtttattactgtcagcagcgtatcgactggatcaccttcggccaagggacacgactggaaattaaacgaactgtggctgcacatctgtcttcatt

SEQ ID NO: 562194 - DNA, 517 bp, Homo sapiens
  misc_feature: HIJSMM301EMNHG.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctactgactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtgttcggcggagggaccaagctggccgtcctaggtcagcccaaggctgccccctcggtcactctgttcccgcctctcgagtacgactctagc

SEQ ID NO: 562195 - DNA, 521 bp, Homo sapiens; identical to SEQ ID NO: 539470
  misc_feature: HIJSMM301DW955.27.23.C01.1.454.light.4.raw

SEQ ID NO: 562196 - DNA, 485 bp, Homo sapiens
  misc_feature: HIJSMM301CVJJM.19.71.G05.1.454.light.4.raw
tactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatacgaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttatattgtcaacaatattattatacttcgtggacgttcggccaagggaccaaaggtggatatcagacgaa

SEQ ID NO: 562197 - DNA, 487 bp, Homo sapiens
  misc_feature: HIJSMM301AMKKC.22.73.G07.1.454.light.4.raw
acatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagtctggtaccagcagagacctggccaggctcccaggctcctcatctatggtgcttctaccagggccactggtatccccgccaggttcagtgccagtgggtctgggacagagttcactctcaccatcagcagcctgcagtctgaagattttgcactttattactgtcagcaatataatgactggttctcgatcaccttcggccaagggacacgactggagattaaacgaactagtggctgcaccatctgt

SEQ ID NO: 562198 - DNA, 487 bp, Homo sapiens; identical to SEQ ID NO: 546877
  misc_feature: HIJSMM301DK865.41.44.D11.1.454.light.4.raw

SEQ ID NO: 562199 - DNA, 383 bp, Homo sapiens; identical to SEQ ID NO: 447524
  misc_feature: HIJSMM301DA4O1.41.26.C04.1.454.light.4.raw

SEQ ID NO: 562200 - DNA, 484 bp, Homo sapiens
  misc_feature: HIJSMM301DT7H2.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtccaagtaactttggccagggaccaagctggagatcaaacgaactgtggctgcaccat

SEQ ID NO: 562201 - DNA, 514 bp, Homo sapiens; identical to SEQ ID NO: 541418
  misc_feature: HIJSMM301EMYY7.17.33.C11.1.454.light.4.raw

SEQ ID NO: 562202 - DNA, 486 bp, Homo sapiens
  misc_feature: HIJSMM301BPIHE.43.4.A04.1.454.light.4.raw
tgtgagtagtcacgaccggtgctcgatttagagtagtgatcagggggaagagctgctcagttaggacccagagggaaccatggaaaccccagcgcagcttctcttcctcctgctactctggctcccagtctcagatatcaccggagaaattgtgttggcgcagtctcctggcaccctgtctttgtctccaggggagagagccacgctctcttgcagggccagtcagagtatcagtagcaactacttaacctggtaccagcagaaatctggccaggctcccaggctcctcatctacagtgcgtccaggagggcctctggcatcccagacaggttcagtggcagtgggtctgggacagacttcactctcaccatctccagactggagcctgaagattttgcagtgtattactgtcagcaatttaatacttcagtctggacgttcggccaagggaccaaggtggacatcaaacgaactgtggctgcacc

SEQ ID NO: 562203 - DNA, 446 bp, Homo sapiens
  misc_feature: HIJSMM301AIQTW.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccgccctcctccatactcga

SEQ ID NO: 562204 - DNA, 508 bp, Homo sapiens
  misc_feature: HIJSMM301AQ1AY.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcggggcgttcggccaagggaccgaaggtggaaagtacaaacgaactagtggctgcaccatctgtcttcatcttccccg

SEQ ID NO: 562205 - DNA, 514 bp, Homo sapiens
  misc_feature: HIJSMM301BV2D0.7.86.H09.1.454.light.4.raw
  modified_base (211)..(211): a, c, t, g, unknown or other
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctccgtgggggganagccaccctctcctgcagggccagtgaaccttttagtagtagttatttagcctggtatcggacaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtcccgtggacgttcggcaaggaccaaggtggcaatcaaccaactgtgctgcaccatctgtctcatcttccccg

SEQ ID NO: 562206 - DNA, 493 bp, Homo sapiens; identical to SEQ ID NO: 535566
  misc_feature: HIJSMM301EAILG.16.6.A06.1.454.light.4.raw

SEQ ID NO: 562207 - DNA, 494 bp, Homo sapiens
  misc_feature: HIJSMM301AYF26.13.46.E02.1.454.light.4.raw
tcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatcagcagggtggaggctgaggatgttattgggctctattattgcatgcaagcaacacactggccgtacacttttggtccaggggaccaaggctggagatcaatcgaactgtgg

SEQ ID NO: 562208 - DNA, 506 bp, Homo sapiens; identical to SEQ ID NO: 542696
  misc_feature: HIJSMM301B0U7E.7.71.G05.1.454.light.4.raw

SEQ ID NO: 562209 - DNA, 511 bp, Homo sapiens
  misc_feature: HIJSMM301D8Q7P.17.62.F07.1.454.light.4.raw
cgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctggtcactctgttcccacctcctcctagtctacg

SEQ ID NO: 562210 - DNA, 474 bp, Homo sapiens
  misc_feature: HIJSMM301DNY4M.5.12.B01.1.454.light.4.raw
atcagacacgcacgaccggtgctcgatttagtagtgtagattccgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaacagtgacattggtgcttatgactatgtctcgtggtatcaaaagtatccagacacagcccccaaactcatcctttatgatgtccgtgttcggccctcaggggtttctgttcgcttctctggctccaagtctggcagcacggcctccctgaccatctctgggctccaggctgaggacgaggctgactattattgcagttcatatggtagtatgaagactcttgtgattttcggcggtagggaccaagctgaccgt

SEQ ID NO: 562211 - DNA, 494 bp, Homo sapiens; identical to SEQ ID NO: 534992
  misc_feature: HIJSMM301BMXJF.9.1.A01.1.454.light.4.raw

SEQ ID NO: 562212 - DNA, 484 bp, Homo sapiens; identical to SEQ ID NO: 536393
  misc_feature: HIJSMM301BS5MW.4.41.D08.1.454.light.4.raw

SEQ ID NO: 562213 - DNA, 480 bp, Homo sapiens; identical to SEQ ID NO: 540232
  misc_feature: HIJSMM301DJRSC.21.14.B03.1.454.light.4.raw

SEQ ID NO: 562214 - DNA, 500 bp, Homo sapiens
  misc_feature: HIJSMM301EDSZ1.48.53.E09.1.454.light.4.raw
agtatacatacacgaccggtgctcgatttagagagagtgtgttgggtttgggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaatatgcttattggtaccagcagaagtcaggccaggcccctgtgctggtcatctttgaggacaacaaacgaccctccgggatccctgagagattctctggctccagctcagggacaatggccaccttgactatcaatgggcccaggtggacgatgaggctgactactactgttcctcaacagacagtagtggtgatcgagggctgttcggcggagggaccaagctgaccgtcctaagtcagcccaaggcctgccccctcggtcta

SEQ ID NO: 562215 - DNA, 505 bp, Homo sapiens; identical to SEQ ID NO: 538224
  misc_feature: HIJSMM301D3POX.16.46.E02.1.454.light.4.raw

SEQ ID NO: 562216 - DNA, 492 bp, Homo sapiens
  misc_feature: HIJSMM301E31GG.4.24.C02.1.454.light.4.raw
agcactgtagcacgaccggtgctcgatttagtacagatcgttagggaaagggggagtcagactcagtcaggacacagcatggacatgagggtccccgctcagctcctggggctcctgctgctctggctcccaggtgccaaatgtgacgtccagatgacccagtctccttccaccctgtctgcatctataggagacagagtcaccatcacttgccgggccagtcagagtattagtaactggttggcctggtatcagcagaaaccaggcaaagccccaaaactccttatctctgatgcctccactttgcacggtggggtcccaccaacgttcagcggcagtgggtctgggacagaattcactctcaccatcagcagcctgcaacctgatgatgttgcaacttattactgtcaacaatataacagttattggacgttcggccaagggaccaaggtggaaatcagacgaaactgtggctgcaccatctgtcttcta

SEQ ID NO: 562217 - DNA, 488 bp, Homo sapiens; identical to SEQ ID NO: 537260
  misc_feature: HIJSMM301CO4RC.47.70.G04.1.454.light.4.raw

SEQ ID NO: 562218 - DNA, 485 bp, Homo sapiens; identical to SEQ ID NO: 535880
  misc_feature: HIJSMM301CCKV2.7.75.G09.1.454.light.4.raw

SEQ ID NO: 562219 - DNA, 492 bp, Homo sapiens; identical to SEQ ID NO: 543155
  misc_feature: HIJSMM301D46JH.10.53.E09.1.454.light.4.raw

SEQ ID NO: 562220 - DNA, 488 bp, Homo sapiens; identical to SEQ ID NO: 537260
  misc_feature: HIJSMM301BWSN9.47.70.G04.1.454.light.4.raw

SEQ ID NO: 562221 - DNA, 502 bp, Homo sapiens; identical to SEQ ID NO: 536253
  misc_feature: HIJSMM301AHQGH.21.22.B11.1.454.light.4.raw

SEQ ID NO: 562222 - DNA, 505 bp, Homo sapiens; identical to SEQ ID NO: 538422
  misc_feature: HIJSMM301A023Y.19.78.H01.1.454.light.4.raw

SEQ ID NO: 562223 - DNA, 501 bp, Homo sapiens; identical to SEQ ID NO: 539914
  misc_feature: HIJSMM301C8DGK.19.78.H01.1.454.light.4.raw

SEQ ID NO: 562224 - DNA, 484 bp, Homo sapiens; identical to SEQ ID NO: 535287
  misc_feature: HIJSMM301DHNEJ.13.56.F01.1.454.light.4.raw

SEQ ID NO: 562225 - DNA, 511 bp, Homo sapiens
  misc_feature: HIJSMM301DH780.13.38.D05.1.454.light.4.raw
tcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcggtccaggaccaacggtaggaagtacaagacgaactcgtggctggcaccactctcgtcttctactcttcccgt

SEQ ID NO: 562226 - DNA, 440 bp, Homo sapiens; identical to SEQ ID NO: 539180
  misc_feature: HIJSMM301BYAL5.11.3.A03.1.454.light.4.raw

SEQ ID NO: 562227 - DNA, 497 bp, Homo sapiens; identical to SEQ ID NO: 542406
  misc_feature: HIJSMM301BA0FF.9.53.E09.1.454.light.4.raw

SEQ ID NO: 562228 - DNA, 477 bp, Homo sapiens; identical to SEQ ID NO: 543928
  misc_feature: HIJSMM301EKPZG.16.86.H09.1.454.light.4.raw

SEQ ID NO: 562229 - DNA, 505 bp, Homo sapiens; identical to SEQ ID NO: 546412
  misc_feature: HIJSMM301E1A26.22.21.B10.1.454.light.4.raw

SEQ ID NO: 562230 - DNA, 486 bp, Homo sapiens
  misc_feature: HIJSMM301BDNMT.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcgaccaagggaccaaggtggatatcagacgaa

SEQ ID NO: 562231 - DNA, 486 bp, Homo sapiens; identical to SEQ ID NO: 535043
  misc_feature: HIJSMM301CB9KT.46.35.D02.1.454.light.4.raw

SEQ ID NO: 562232 - DNA, 484 bp, Homo sapiens; identical to SEQ ID NO: 536162
  misc_feature: HIJSMM301BYYKF.13.59.F04.1.454.light.4.raw

SEQ ID NO: 562233 - DNA, 494 bp, Homo sapiens
  misc_feature: HIJSMM301CSBTT.51.34.D01.1.454.light.4.raw
cgatcgtatacacgaccggtgctcgatttagatcgtctgtgttgggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgt

SEQ ID NO: 562234 - DNA, 495 bp, Homo sapiens; identical to SEQ ID NO: 555504
  misc_feature: HIJSMM301BFBRJ.51.23.C01.1.454.light.4.raw

SEQ ID NO: 562235 - DNA, 514 bp, Homo sapiens
  misc_feature: HIJSMM301CY5WN.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtccactctgttcccaccctcct

SEQ ID NO: 562236 - DNA, 468 bp, Homo sapiens
  misc_feature: HIJSMM301AZSJB.3.20.B09.1.454.light.4.raw
agacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcgtctatttaaattggtatcagcacaaaccagggaaagcccctaagctcctgatctatgctgaatccactttgcaaagtggggtcccatcaaggttcagtggcagtggatctgggacagatttcactctaaccatcagcggtctgcaacctgaagattttgcaactcactactgtcaacagagtgacagcacgcctcacactttcggcggagggaccaaggtggagagtcaaacgaaa

SEQ ID NO: 562237 - DNA, 478 bp, Homo sapiens; identical to SEQ ID NO: 535129
  misc_feature: HIJSMM301DFZCA.11.11.A11.1.454.light.4.raw

SEQ ID NO: 562238 - DNA, 505 bp, Homo sapiens; identical to SEQ ID NO: 535503
  misc_feature: HIJSMM301AZRP2.8.28.C06.1.454.light.4.raw

SEQ ID NO: 562239 - DNA, 490 bp, Homo sapiens
  misc_feature: HIJSMM301CX1UB.13.36.D03.1.454.light.4.raw
tcacgtactacacgaccggtgctcgatttagctgcgtcacgatctcgtcttgggggggtcagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggctcccaggctcctcatttatggtgcatccactagggccactggtgtcccagtcaggttcagcggcagtgggtctgggacagacttcactctcaccatcagcagcctgcagtctgaagattttgcagtctattactgtcagcagtatagttactggagaaccttcggccaagggacgacgactggagagttaaaggaact

SEQ ID NO: 562240 - DNA, 500 bp, Homo sapiens
  misc_feature: HIJSMM301DWZHB.10.65.F10.1.454.light.4.raw
catagtagtgcacgaccggtgctcgatttagctacgctctaagggggcaggagtcagtctcagtcaggacacagcatggacatgagggtccccgctcagctcctggggctcctgctactctggctccgaggtgccagatgtgacatccagatgacccagtctccaccgtccctgtctgcatttgttggagacagagtcaccatctcttgccggacaagtcagaacattgacacctatttgaattggtatcaacaaaaactggggaaagcccctacactcctgatcaatgcagcgtccagtttacagagtggggtcccctcaaggttcagtggcagtggatctgggacagactttactctcaccatcagcgatctgcagcctgacgattttgcgacttactactgtcaacagagtttccggaaccccgttactttcggtcggagggaccaaggtggagatcaaacgaactgtggctgcaccatctgtcttcatcttccccg

SEQ ID NO: 562241 - DNA, 493 bp, Homo sapiens
  misc_feature: HIJSMM301BUBB3.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattctccagcgttcgccaggggaccgaaggtggaagtcaagcgaaactgtggctggcaccaactctgtt

SEQ ID NO: 562242 - DNA, 483 bp, Homo sapiens
  misc_feature: HIJSMM301EQ53L.41.80.H03.1.454.light.4.raw
tctatactatcacgaccggtgctcgatttagctgtgcgtcgaagggaaagggggagtcagtcccaaccaggacacagcatggacatgagggtccctgctcagcttctggggctcctgctgctctggctctcaggtgccagatgtgacatccagatgacccagtctccaacctccctgtctgcatctgtaggagacagagtcaccatcacttgccaggccagtcaggacattagcaactatttaaattggtatcagcagaaaccagggaaagcccctaagctcctgatctacgatgcatccaatttggaatcaggggtcccatcaaggttcagtggaagtggatctgggacagattttactttcaccatcaccagcctgcagcctgaagatattgcaacatattactgtcaacagtatgataatctccctcccactttcggcggagggaccaaggtggagatcaaacgaactgtggctgcacca

SEQ ID NO: 562243 - DNA, 493 bp, Homo sapiens; identical to SEQ ID NO: 535745
  misc_feature: HIJSMM301EUWFI.47.78.H01.1.454.light.4.raw

SEQ ID NO: 562244 - DNA, 511 bp, Homo sapiens
  misc_feature: HIJSMM301B7IDL.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctcggtcactctgttcccgccctcctcgctacgt

SEQ ID NO: 562245 - DNA, 496 bp, Homo sapiens
  misc_feature: HIJSMM301D0GM3.19.71.G05.1.454.light.4.raw
tactctcgtgcacgaccggtgctcgatttagtgtcgtcgcaagagagaggggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttggccaagggaccaaggtggatatcagacgaactgtggctgcaa

SEQ ID NO: 562246 - DNA, 494 bp, Homo sapiens; identical to SEQ ID NO: 534994
  misc_feature: HIJSMM301DUYUP.27.78.H01.1.454.light.4.raw

SEQ ID NO: 562247 - DNA, 504 bp, Homo sapiens
  misc_feature: HIJSMM301EQQ4C.19.85.H08.1.454.light.4.raw
tactctcgtgcacgaccggtgctcgatttagtatcactcagtcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccaccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctgggtcagcccaaggctgccccctcc

SEQ ID NO: 562248 - DNA, 505 bp, Homo sapiens; identical to SEQ ID NO: 547383
  misc_feature: HIJSMM301EJ4BO.3.79.H02.1.454.light.4.raw

SEQ ID NO: 562249 - DNA, 504 bp, Homo sapiens; identical to SEQ ID NO: 542411
  misc_feature: HIJSMM301BPFAE.9.53.E09.1.454.light.4.raw

SEQ ID NO: 562250 - DNA, 505 bp, Homo sapiens; identical to SEQ ID NO: 547532
  misc_feature: HIJSMM301BULG7.8.1.A01.1.454.light.4.raw

SEQ ID NO: 562251 - DNA, 493 bp, Homo sapiens; identical to SEQ ID NO: 536769
  misc_feature: HIJSMM301ALXPF.19.83.H06.1.454.light.4.raw

SEQ ID NO: 562252 - DNA, 460 bp, Homo sapiens; identical to SEQ ID NO: 537107
  misc_feature: HIJSMM301CQAE7.22.28.C06.1.454.light.4.raw

SEQ ID NO: 562253 - DNA, 444 bp, Homo sapiens; identical to SEQ ID NO: 535027
  misc_feature: HIJSMM301EEB4R.8.73.G07.1.454.light.4.raw

SEQ ID NO: 562254 - DNA, 486 bp, Homo sapiens
  misc_feature: HIJSMM301A9KTX.49.38.D05.1.454.light.4.raw
agtcgagagacacgaccggtgctcgatttagtatctgatagttgggtttgggggctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcgacttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgaagatgtggcagtgtattactgtcagcaatatcacactgctccgctcactttcggcggagggaccagggtggagatcaaacgtaac

SEQ ID NO: 562255 - DNA, 416 bp, Homo sapiens; identical to SEQ ID NO: 539343
  misc_feature: HIJSMM301BY68H.18.78.H01.1.454.light.4.raw

SEQ ID NO: 562256 - DNA, 500 bp, Homo sapiens
  misc_feature: HIJSMM301BIXJQ.10.43.D10.1.454.light.4.raw
catagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccggggccactttcggccctgggaccaagtggatatcaaacgaactgtggctgcaccatctgtcttcatt

SEQ ID NO: 562257 - DNA, 517 bp, Homo sapiens
  misc_feature: HIJSMM301CMX7C.41.25.C03.1.454.light.4.raw
tctatactatcacgaccggtgctcgatttagtagtgtagatttgggtttgggggatagctcaggaagcagagcctggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctggggtccctttcggttttctggctccatcgacagtccctccaactccgcctcccttaccatatctgggctgaagagtgaggacgaggctgactacttctgtcagtcttatgatataaacaattatgtgataattggcggagggaccagggtgaccgtcctaggtcagcccaaggctgccccctcggtcactctgttccca

SEQ ID NO: 562258 - DNA, 496 bp, Homo sapiens
  misc_feature: HIJSMM301CLQPI.43.32.C10.1.454.light.4.raw
tgtgagtagtcacgaccggtgctcgatttagtatagacatcaacacacaaagggggaagagctgctcagttaggacccagagggaaccatggaaaccccagcgcagcttctcttcctcctgctactctggctcccagataccaccggagaaattgtgttgacgcagtctccaggcaccgtgtctttgtctccaggggaaagagccaccttctcttgcagggccagtcagagtgttagcagcaactacttagcctggtaccagcagaaacctggccaggctcccaggctcctcatctatggtgcatccaccagggccactggcatcccagacagattcagtggcactgggtctgggacagacttcactctcaccatcagcagactggaacctgaagattttgcaatttattactgtcagcagtatgcctggtcgcctccggccctcactttcggcggagggaccaaggtggagatcaaacgaactgtggctgcacca

SEQ ID NO: 562259 - DNA, 490 bp, Homo sapiens
  misc_feature: HIJSMM301CTD2J.16.73.G07.1.454.light.4.raw
tgtactactccacgaccggtgctcgatttagctctacgctcagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcaacaatattataataatccatttaatttcggcggagggaccaaggtggagatcaaacgaactgtggctgcacc

SEQ ID NO: 562260 - DNA, 496 bp, Homo sapiens
  misc_feature: HIJSMM301CSWAN.48.63.F08.1.454.light.4.raw
agtatacatacacgaccggtgctcgatttagcgatcgtataagggggagtcagacccagtcaggacacagcatggacatgagggtccccgctcagctcctggggctcctgctgctctggctcccaggtgccgagtgtgacatccagatgacccagtttccttccgccctgtctgcatctgtgggagacagagtcaccatcacttgtcgggccagtcagagtgttaataagtggttggcctggtatcagcagaaacccgggaaagcccctaacctcctaatctatgaggcatctactctacaaagtggagtcccatccaggttcagcggcagtgcatctgggaccgacttcagtctcaccatcagcagcctgcaccctgatgattttgcaacttattactgtcaacaatattatacttacccgtacactttggtccaggggactaagctggagatcaaacgaactgtggctgcaccatctgttcttcatcttccccg

SEQ ID NO: 562261 - DNA, 490 bp, Homo sapiens; identical to SEQ ID NO: 541974
  misc_feature: HIJSMM301BGTPB.22.65.F10.1.454.light.4.raw

SEQ ID NO: 562262 - DNA, 485 bp, Homo sapiens
  misc_feature: HIJSMM301CX1XL.52.44.D11.1.454.light.4.raw
cgcagtacgacacgaccggtgctcgatttagcgcagtacgaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgctctggaaccagcagtgatgttggtaactataactctgtctcctggtaccaacagcacccaggcaaagccccccaactcataattcatgatgtcactaagcggccctcaggggtccctggtcgtttctctgcctccaagtctggcaacacggcctccctgaccatctctgggctccaggctgaggatgaggctgattattactgctgctcatatgcaggcagcaacacttatgtcttcggaactgggaccaaggtcaccgtcctaggtcagcccaa

SEQ ID NO: 562263 - DNA, 501 bp, Homo sapiens
  misc_feature: HIJSMM301C1MJK.5.86.H09.1.454.light.4.raw
atcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagcccgtatactcttcggcggaggaccaagctgaccgtcctaggtcagcccaaggctgccccctc

SEQ ID NO: 562264 - DNA, 444 bp, Homo sapiens; identical to SEQ ID NO: 535192
  misc_feature: HIJSMM301AUSJO.5.9.A09.1.454.light.4.raw

SEQ ID NO: 562265 - DNA, 447 bp, Homo sapiens; identical to SEQ ID NO: 535201
  misc_feature: HIJSMM301ENJO4.18.9.A09.1.454.light.4.raw

SEQ ID NO: 562266 - DNA, 493 bp, Homo sapiens
  misc_feature: HIJSMM301EL2DU.4.72.G06.1.454.light.4.raw
agcactgtagcacgaccggtgctcgatttagctacgactgcaagggaaagggggaggaactgctcagttaggacccagacggaaccatggaagccccagcgcagcttctcttcctcctgctactctggctcccagaaagcagtggagaagtagtgatgacgcagtctccagccaccctgcctgtgtctccaggggacactgccaccctctcctgcagggccagtcagagtgttggcactaatttagcctggtaccagcagaaacctggccaagctcccaggctgctcatctataatacaatcacaagggacattggtgtcccagacaggttcagcggcagtgggtctgggacagagttcactctcactatcagcagcctgcactttgaagattttgcagtctatcattgtcagcagtataattggtggcctcggacgttcgccgaacggaccgaacggtggaaagtacaaacgaactacgtggcgtgcaccat

SEQ ID NO: 562267 - DNA, 493 bp, Homo sapiens; identical to SEQ ID NO: 539015
  misc_feature: HIJSMM301CLVZY.27.78.H01.1.454.light.4.raw

SEQ ID NO: 562268 - DNA, 448 bp, Homo sapiens; identical to SEQ ID NO: 540364
  misc_feature: HIJSMM301AL47Z.18.9.A09.1.454.light.4.raw

SEQ ID NO: 562269 - DNA, 495 bp, Homo sapiens; identical to SEQ ID NO: 535007
  misc_feature: HIJSMM301CT0H8.22.5.A05.1.454.light.4.raw

SEQ ID NO: 562270 - DNA, 483 bp, Homo sapiens
  misc_feature: HIJSMM301BXJVZ.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttatattgtcaacaatattattatacttcgtggacgttcggcaagggaccaggtggatatcagacgaa

SEQ ID NO: 562271 - DNA, 487 bp, Homo sapiens; identical to SEQ ID NO: 537220
  misc_feature: HIJSMM301B8K2R.16.53.E09.1.454.light.4.raw

SEQ ID NO: 562272 - DNA, 502 bp, Homo sapiens
  misc_feature: HIJSMM301APE4G.10.26.C04.1.454.light.4.raw
catagtagtgcacgaccggtgctcgattagtctagcgactttgggtttgggggctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtcccgtggacgttcgcaggacagtgcatcacactgtgctgcaccatctgtcttcatcttcccgccta

SEQ ID NO: 562273 - DNA, 495 bp, Homo sapiens
  misc_feature: HIJSMM301AV0DI.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgcagtctgaagattttgcagtttattactgtcagcagtatgatacctggcctccgtacacttttggccgggggaccaagctggaaatcaagcgaactgtggctgcaccatctgtcttcattcc

SEQ ID NO: 562274 - DNA, 476 bp, Homo sapiens
  misc_feature: HIJSMM301DKV65.51.29.C07.1.454.light.4.raw
  modified_base (473)..(473): a, c, t, g, unknown or other
cgatcgtatacacgaccggtgctcgatttagagtgctacgaagggaaagggggaggaactgctcagtcaggacccagacggaaccatggaagccccagcgcagcttctcttcctcctgctactctggctcccagatactactggagaaatagtgatgacgcagtctccagccacgctgtctgtgtctccaggggaaagagccaccctctcctgcagggccagtcagagtgttaacaacaacttagcctggtatcagcagaaacctggccaggctcccaggctcctcatctttggatcatccatcagggccactggtgtcccagaaaaagttcagtggcggtgggtctgacacagagtacaccctcaccatcagcaccctgcagtctgaagatgtcgcagtttattactgtcaacaatatagtgacaggccgccatggagtgtcgacgacgaagaggaagagaagaagagtagngtg

SEQ ID NO: 562275 - DNA, 490 bp, Homo sapiens; identical to SEQ ID NO: 549097
  misc_feature: HIJSMM301CLT0J.17.21.B10.1.454.light.4.raw

SEQ ID NO: 562276 - DNA, 493 bp, Homo sapiens
  misc_feature: HIJSMM301ELLRN.15.59.F04.1.454.light.4.raw
tctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaaagctgccctcaccatcacgggggcccaggcagatgatgaatctgtttatattgtgtcctatatatgggtgctggcatttcggtcttcggcggagggaccaagctgaccgtcctaggtcagcccaaggctgccccctcggtcactctgttcccgccctcctcgctacgtaga

SEQ ID NO: 562277 - DNA, 504 bp, Homo sapiens; identical to SEQ ID NO: 560954
  misc_feature: HIJSMM301CYSP6.14.3.A03.1.454.light.4.raw

SEQ ID NO: 562278 - DNA, 488 bp, Homo sapiens; identical to SEQ ID NO: 538017
  misc_feature: HIJSMM301CYAFY.4.59.F04.1.454.light.4.raw

SEQ ID NO: 562279 - DNA, 510 bp, Homo sapiens; identical to SEQ ID NO: 538767
  misc_feature: HIJSMM301BE09I.17.28.C06.1.454.light.4.raw

SEQ ID NO: 562280 - DNA, 463 bp, Homo sapiens; identical to SEQ ID NO: 535062
  misc_feature: HIJSMM301E1INF.11.73.G07.1.454.light.4.raw

SEQ ID NO: 562281 - DNA, 472 bp, Homo sapiens
  misc_feature: HIJSMM301C8CYQ.11.17.B06.1.454.light.4.raw
cgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccgggcaagtcagatcattagcagctatttaaattggtatcagcagaaaccagggaaagcccctgaggtcctgatctatgctgcatccagtttgcagagtggggtcccatcaaggttcagtggcagtggatctgcgacagatttcactctcaccatcagcagtctgcaacctgaagattttgcaacttactactgtcaacagagttacagtaccccgtggacgttcggccaggaccaaggtaggaaatacaaacgaactgtgg

SEQ ID NO: 562282 - DNA, 473 bp, Homo sapiens; identical to SEQ ID NO: 535262
  misc_feature: HIJSMM301E28Q1.8.67.G01.1.454.light.4.raw

SEQ ID NO: 562283 - DNA, 510 bp, Homo sapiens
  misc_feature: HIJSMM301C9H12.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctcggtcactctgttcccaccctcctcgctacgt

SEQ ID NO: 562284 - DNA, 493 bp, Homo sapiens; identical to SEQ ID NO: 535973
  misc_feature: HIJSMM301EN31Z.18.11.A11.1.454.light.4.raw

SEQ ID NO: 562285 - DNA, 487 bp, Homo sapiens; identical to SEQ ID NO: 538190
  misc_feature: HIJSMM301EZWJO.47.70.G04.1.454.light.4.raw

SEQ ID NO: 562286 - DNA, 487 bp, Homo sapiens
  misc_feature: HIJSMM301DVMEI.47.36.D03.1.454.light.4.raw
agctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacttgtcgggcgagtcagggtattagcaactggttagcctggtatcaacagaaaccagggaaagcccctaacctcctcatctctactgcatccactttgcaaagtgggtcccatcaaggttcagcggcagtggatctgggacagatttcactctcactatcagcagcctgcagcctgaagattttggaacttattattgtcaacagggtaacagtttcccgctcaccttcggcggagggaccaaggtggagatgaaagaactgtggctgcaccat

SEQ ID NO: 562287 - DNA, 505 bp, Homo sapiens; identical to SEQ ID NO: 538054
  misc_feature: HIJSMM301ANDML.8.55.E11.1.454.light.4.raw

SEQ ID NO: 562288 - DNA, 466 bp, Homo sapiens; identical to SEQ ID NO: 548332
  misc_feature: HIJSMM301EQ2MY.13.4.A04.1.454.light.4.raw

SEQ ID NO: 562289 - DNA, 487 bp, Homo sapiens; identical to SEQ ID NO: 537079
  misc_feature: HIJSMM301EFBSS.14.55.E11.1.454.light.4.raw

SEQ ID NO: 562290 - DNA, 499 bp, Homo sapiens
  misc_feature: HIJSMM301EL520.15.81.H04.1.454.light.4.raw
tctacgtagccacgaccggtgctcgatttagtagtgtagattcgcggggggggtcgtcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcggcggtgggaccaagctgaccgtcctaggtcagcccaaggctgccccctcc

SEQ ID NO: 562291 - DNA, 503 bp, Homo sapiens
  misc_feature: HIJSMM301D877K.9.71.G05.1.454.light.4.raw
tgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcggagggaccaggctgaccgtcctgagtcagcccaaggctgccccccg

SEQ ID NO: 562292 - DNA, 503 bp, Homo sapiens; identical to SEQ ID NO: 536834
  misc_feature: HIJSMM301DYOQZ.2.35.D02.1.454.light.4.raw

SEQ ID NO: 562293 - DNA, 489 bp, Homo sapiens
  misc_feature: HIJSMM301COJDE.3.10.A10.1.454.light.4.raw
agacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcaccgtcctaggtcagcccaaggccaacccc

SEQ ID NO: 562294 - DNA, 500 bp, Homo sapiens; identical to SEQ ID NO: 542271
  misc_feature: HIJSMM301EIR7Q.19.78.H01.1.454.light.4.raw

SEQ ID NO: 562295 - DNA, 504 bp, Homo sapiens
  misc_feature: HIJSMM301DCLWK.13.53.E09.1.454.light.4.raw
tcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcgtccgaacggaccgaacggtaggaaagtacaagacgaactgtggcgtgcaccatctgtcttc

SEQ ID NO: 562296 - DNA, 511 bp, Homo sapiens
  misc_feature: HIJSMM301EFNZX.10.80.H03.1.454.light.4.raw
catagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctgtgggggagacagcattgaaagtgaagctgtccactggtaccagcagaggccaggccaggcccctgtactggtcctctatgatgatagtgaccggccctcagggatccctgagcgattctctggctccaactctgggaacacggccaccctgaccatcaccagggtcgaagccggggatgaggccgactattattgtcaggtgtggtatttcagtagtattcatccgggggttttcgcggagggaccaagctgaccgtcctaggtcagcccaaggctgccccctcggtcactctgttccc

SEQ ID NO: 562297 - DNA, 506 bp, Homo sapiens; identical to SEQ ID NO: 545155
  misc_feature: HIJSMM301BGQ1Z.9.12.B01.1.454.light.4.raw

SEQ ID NO: 562298 - DNA, 492 bp, Homo sapiens; identical to SEQ ID NO: 546067
  misc_feature: HIJSMM301ERCFV.43.77.G11.1.454.light.4.raw

SEQ ID NO: 562299 - DNA, 479 bp, Homo sapiens
  misc_feature: HIJSMM301ATO2U.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactaccctctcactttcgcggggaccgaaggtggagatcaacgaactgtggctgcacca

SEQ ID NO: 562300 - DNA, 419 bp, Homo sapiens
  misc_feature: HIJSMM301D85EY.41.53.E09.1.454.light.4.raw
tctatactatcacgaccggtgctcgatttagagagagtgtgttgggtttgggggctttgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggagggaccaagctgaccgtcctaggtcagcccaaggctgccccctcggtcactctgttcccgccctcctcatagtataga

SEQ ID NO: 562301 - DNA, 449 bp, Homo sapiens
  misc_feature: HIJSMM301AX8QM.8.73.G07.1.454.light.4.raw
ctcgcgtgtccacgaccggtgctcgatttagctctacgctcagggtcctggggcccagtctgtactgacgcagccgccctcagtatctggggccccagggcagagggtctccatctcctgcactgggagcagaaccagccagtcggggcaggttatgatgttcattggtaccgccaggttccaggcacagcccccaggactcctcattaatgataacaacaatcggccctcaggggtctctgtaccgattctctgcctccaaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctggtcactctgttcccaccctcctcgacacgcgag

SEQ ID NO: 562302 - DNA, 498 bp, Homo sapiens
  misc_feature: HIJSMM301B2FII.41.3.A03.1.454.light.4.raw
tctatactatcacgaccggtgctcgatttagagagcgtcacaggggagagctgctcagttaggacccagagggaaccatggaaaccccagcgcagcttctcttcctcctgctactctggctcccaggtgccaccggagaaattgtgttgacgcagtctccaggcaccctgtctttctctccaggggaaagagccaccctctcctgcagggccagtcagagtgttgacaaccagtacttcgcctggtaccagcagaaacctggccaggctcccaggctcctcatggatggtgcatccagcagggccactggcatcccagacaggttcggtggcagtgggtctgggacagacttcactctcaccatcagcagcctggagcctgaagattttgtagtgtattactgtcagcagtatcttacaacaccggggagttttggccaggggaccaagctggagatcaaacgaactgtggctgcaccatctgtcttcatcttccccg

SEQ ID NO: 562303 - DNA, 496 bp, Homo sapiens
  misc_feature: HIJSMM301BWOIT.40.37.D04.1.454.light.4.raw
tctagcgactcacgaccggtgctcgatttagtagcatactgttgggtttgggggatcaggacttctcagttcatcttctcaccatgaggctccctgctcagctcctggggctgctaatgctctggatccctggttccagtgcgagggttgtgatgactcagactccactctctctgtccgtcacccctggacagccggcctccatctcctgcaagtctgctcagagcctcctgcatggtgatggaatcacctatttatattggtacctgcagaagccaggccagtctccacagctcctaatctatgaggtttccagccggttctctggagtgccagataggttcagtggcagcgggtcagtgacagatttcacactgaaaatcagccgggtggaggctgaggatgttggggtttattactgcatgcaaggtttataccttcctcggactttcggtccctcgggaccgacgagtaggagtgtctaaacgaacctagt

SEQ ID NO: 562304 - DNA, 487 bp, Homo sapiens
  misc_feature: HIJSMM301BWIJB.48.10.A10.1.454.light.4.raw
agtatacatacacgaccggtgctcgatttagcgtcgatctcagggggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggaccttcggccagggaccgagggtggaaagtacaaacgaactagtggctgcaccatctgtctt

SEQ ID NO: 562305 - DNA, 484 bp, Homo sapiens; identical to SEQ ID NO: 538770
  misc_feature: HIJSMM301BKK48.4.57.F02.1.454.light.4.raw

SEQ ID NO: 562306 - DNA, 494 bp, Homo sapiens; identical to SEQ ID NO: 534992
  misc_feature: HIJSMM301EIJ92.9.1.A01.1.454.light.4.raw

SEQ ID NO: 562307 - DNA, 475 bp, Homo sapiens; identical to SEQ ID NO: 537714
  misc_feature: HIJSMM301DNLYY.7.81.H04.1.454.light.4.raw

SEQ ID NO: 562308 - DNA, 444 bp, Homo sapiens; identical to SEQ ID NO: 537971
  misc_feature: HIJSMM301CBPQR.2.76.G10.1.454.light.4.raw

SEQ ID NO: 562309 - DNA, 500 bp, Homo sapiens
  misc_feature: HIJSMM301A12AB.7.5.A05.1.454.light.4.raw
cgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggtttccgtaatcgcttctctggctccaagtctggcgacacggcctccctgaccatctctgggctccaggctgaagacgaggctgattattactgcagctcatatacaggcagcagcactcaggttttcggcggagggaccaagctgaccgtcctaggtcagcccaaggctgccccctcggtcc

SEQ ID NO: 562310 - DNA, 448 bp, Homo sapiens; identical to SEQ ID NO: 540018
  misc_feature: HIJSMM301C7DGV.18.9.A09.1.454.light.4.raw

SEQ ID NO: 562311 - DNA, 495 bp, Homo sapiens
  misc_feature: HIJSMM301C42XD.51.81.H04.1.454.light.4.raw
cgatcgtatacacgaccggtgctcgatttagtagtgtagattcgcggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcactctcg

SEQ ID NO: 562312 - DNA, 488 bp, Homo sapiens; identical to SEQ ID NO: 536861
  misc_feature: HIJSMM301D2G04.12.88.H11.1.454.light.4.raw

SEQ ID NO: 562313 - DNA, 505 bp, Homo sapiens
  misc_feature: HIJSMM301AYNU9.2.71.G05.1.454.light.4.raw
acgctcgacacacgaccggtgctcgatttagtgtcgtcgcaagagagaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaggacaggcccctgtaattgtcatctatggaatctatggtaaaaacaaccggccctcagggatcccagaccgattctctggctcctactcaggaaacacagcttccttgaccatcactggggctcaggcggaagatgaggctgactattattgtaagtccggggacagaagtggtaattacatggtgttcggcggagggaccaagctgaccgtcctacgtcagcccaagctgccccctcggtcactc

SEQ ID NO: 562314 - DNA, 495 bp, Homo sapiens
  misc_feature: HIJSMM301BF0AQ.16.6.A06.1.454.light.4.raw
tgtactactccacgaccggtgctcgatttagatctactgacagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagcttggtaccagcagaaaccggggcagtctcctaagttgctcatttactgggcgtctacccgggaatccggggtccctgaccgattcagtggcagcgggtctgggacagatttcactctcaccatcagcagcctgcaggttgaagatgtggcagtttattactgtcagcagtattatactactcctctgtacgttcggccaagggaccaaggtggagatcaaacgaactgtggctgcaccat

SEQ ID NO: 562315 - DNA, 501 bp, Homo sapiens; identical to SEQ ID NO: 535873
  misc_feature: HIJSMM301D7J4X.17.27.C05.1.454.light.4.raw

SEQ ID NO: 562316 - DNA, 477 bp, Homo sapiens; identical to SEQ ID NO: 535266
  misc_feature: HIJSMM301ES429.4.34.D01.1.454.light.4.raw

SEQ ID NO: 562317 - DNA, 507 bp, Homo sapiens; identical to SEQ ID NO: 535641
  misc_feature: HIJSMM301EHA8D.10.88.H11.1.454.light.4.raw

SEQ ID NO: 562318 - DNA, 518 bp, Homo sapiens
  misc_feature: HIJSMM301CP5O9.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtctaggtcagcccaaggctgccccctcggtcactctcgttcccaccctcctcacg

SEQ ID NO: 562319 - DNA, 493 bp, Homo sapiens; identical to SEQ ID NO: 535745
  misc_feature: HIJSMM301CXFVK.47.78.H01.1.454.light.4.raw

SEQ ID NO: 562320 - DNA, 501 bp, Homo sapiens
  misc_feature: HIJSMM301BNEVF.41.35.D02.1.454.light.4.raw
tctatactatcacgaccggtgctcgatttagcacacgatagttgggtttggggagtctgggcctaaggaagcagcactggtggtgcctcagccatggcctggaccgttctcctcctcggcctcctctctcactgcacagcctctgtgacctcctatgtgttgactcagccaccctcggcgtcagtggccctaggacagacggccaggattacctgtggggcaaataagataggaactacaaatgtgcactggtaccaacagaggccaggccaggcccctgtggtggtcgtccatgatgattacgaccggccctcaggaatccctgagcgattctctggctccaattctgggaacacagccactctgaccatcagcgggacccaggctatggatgaggctgactattactgtcaggcgtgggacatcagcagtgaggtggttttcggcggagggaccaagctgaccgtcctaagtcagcccaaggctgccccctcggtcact

SEQ ID NO: 562321 - DNA, 441 bp, Homo sapiens; identical to SEQ ID NO: 535074
  misc_feature: HIJSMM301A9D73.11.3.A03.1.454.light.4.raw

SEQ ID NO: 562322 - DNA, 480 bp, Homo sapiens
  misc_feature: HIJSMM301BDTDB.14.11.A11.1.454.light.4.raw
cgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgacccagtctccatcctccctgtctgcatctgtaggagacagagtcaccatcacttgccgggcaagtcagttcattagaaatgagttaggctggtatcagcagaaaccagggaaagcccctaagctcctgatctatgctgcgtccaatttacaaactggggtcccatcaaggttcagcggcagtggatctggcacagatttcactctcaccatcagcagcctgcagcctgaagattttgcaacttattactgtctacaagattacaattaccctcgaacgttcggccaagggaccaaggtggaagtcaaacgaactgtggctgcacat

SEQ ID NO: 562323 - DNA, 495 bp, Homo sapiens
  misc_feature: HIJSMM301AN6DN.43.72.G06.1.454.light.4.raw
tgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtggccgcctatgagttgactcagccaccctcagtgtccgtgtccccaggacagacagccagcatcacctgctctggagataaattgggggataaatatgcctcctggtatcagcagaagccaggcgagtcccctgtgttggtcatctatcaagatgacaaacggccctcagggatccctgagcgattctctggctccaactctgggaacacagccactctgaccatcagcgggaccaggctatggatgaggctgacttttactgtcaggcgtgggacaccaacactgtggttttcggcggagggaccaagctgaccgtcctgggtcagcccaaggctgccccctcggtctacc

SEQ ID NO: 562324 - DNA, 505 bp, Homo sapiens
  misc_feature: HIJSMM301A8WXA.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataatttctgggtgttcggcggagggaccaaactgaccgtcctaggtcagcccaaggctcgccccctcggtcactctgtt

SEQ ID NO: 562325 - DNA, 486 bp, Homo sapiens; identical to SEQ ID NO: 535043
  misc_feature: HIJSMM301EPPCI.46.35.D02.1.454.light.4.raw

SEQ ID NO: 562326 - DNA, 491 bp, Homo sapiens
  misc_feature: HIJSMM301ATD5O.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcaccgtcctaggtcagcccaaggccaaccccactcg

SEQ ID NO: 562327 - DNA, 476 bp, Homo sapiens; identical to SEQ ID NO: 547851
  misc_feature: HIJSMM301CP67Y.13.76.G10.1.454.light.4.raw

SEQ ID NO: 562328 - DNA, 502 bp, Homo sapiens
  misc_feature: HIJSMM301D7FPC.49.37.D04.1.454.light.4.raw
agtcgagagacacgaccggtgctcgatttagtagcatactgttgggtttgggggtgggtccaggaggcagaactctgggtgtctcaccatggcctggatccctctacttctccccctcctcactctctgcacaggctctgaggcctcctctgaattgcaacagacatcctcggtgtcagcgtccccaggacagacggccagaattacttgctctggagatgcattggcgaaacaatttgcttcttggttccagcagaagccaggccaagcccctatcttgatgatctataaaggctctgagaggccctcagggatccctgagcgattctctgggtcccactcaggggccacagccgtgttgaccatcactggagtccaggcagaagacgaggctgactattattgtcagtcagccgacaacactattgtctccgtgttttcggtcggagggaccaggctgaccgtcctggtcagcccaaggctgccccctcggtcactctcg

SEQ ID NO: 562329 - DNA, 516 bp, Homo sapiens
  misc_feature: HIJSMM301A7HMR.5.27.C05.1.454.light.4.raw
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaacccactgtcactctgttcccaccctcctccgt

SEQ ID NO: 562330 - DNA, 503 bp, Homo sapiens; identical to SEQ ID NO: 535044
  misc_feature: HIJSMM301C6ZIS.19.78.H01.1.454.light.4.raw

SEQ ID NO: 562331 - DNA, 489 bp, Homo sapiens; identical to SEQ ID NO: 535139
  misc_feature: HIJSMM301AQZ2X.14.55.E11.1.454.light.4.raw

SEQ ID NO: 562332 - DNA, 517 bp, Homo sapiens
  misc_feature: HIJSMM301CELNC.7.86.H09.1.454.light.4.raw
cgtgtctctacacgaccggtgctcgatttagtgctatagacttgggtttggggagagctctggagaagagctgctcagttaggacccagagggaaccacggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccaaggtggcaatcaaccgaactgtggctgcaccatctgtcttcatcttcccg

SEQ ID NO: 562333 - DNA, 499 bp, Homo sapiens; identical to SEQ ID NO: 551769
  misc_feature: HIJSMM301EMFCD.43.34.D01.1.454.light.4.raw

SEQ ID NO: 562334 - DNA, 505 bp, Homo sapiens
  misc_feature: HIJSMM301BSM2Q.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttatactgtcaacagttttctcgggcgtcggccaagggaccgaaggtggaaagtacaaacgaactagtggctgcgaccatctgtcttcatcttccccg

SEQ ID NO: 562335 - DNA, 495 bp, Homo sapiens
  misc_feature: HIJSMM301BDVXN.19.57.F02.1.454.light.4.raw
tactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgctaactttattttgtcaacaggctaacactttccccctctactttcggcggacgggacaacggtggagatcaagacgaactgtggctgcaccatctgtctt

SEQ ID NO: 562336 - DNA, 478 bp, Homo sapiens; identical to SEQ ID NO: 540986
  misc_feature: HIJSMM301E1BCD.16.86.H09.1.454.light.4.raw

SEQ ID NO: 562337 - DNA, 457 bp, Homo sapiens; identical to SEQ ID NO: 536586
  misc_feature: HIJSMM301EYFNO.49.85.H08.1.454.light.4.raw

SEQ ID NO: 562338 - DNA, 497 bp, Homo sapiens; identical to SEQ ID NO: 543330
  misc_feature: HIJSMM301EMX4W.9.39.D06.1.454.light.4.raw

SEQ ID NO: 562339 - DNA, 491 bp, Homo sapiens; identical to SEQ ID NO: 538388
  misc_feature: HIJSMM301AI52Q.51.81.H04.1.454.light.4.raw

SEQ ID NO: 562340 - DNA, 507 bp, Homo sapiens; identical to SEQ ID NO: 535930
  misc_feature: HIJSMM301A36S7.15.34.D01.1.454.light.4.raw

SEQ ID NO: 562341 - DNA, 510 bp, Homo sapiens; identical to SEQ ID NO: 535474
  misc_feature: HIJSMM301EX07A.17.33.C11.1.454.light.4.raw

SEQ ID NO: 562342 - DNA, 511 bp, Homo sapiens
  misc_feature: HIJSMM301DW48A.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcggtatattactgtcagcaatatggtacttcacccccggacgttcggccgaacggaccgaacggtaggaagtacaaacgaactagtggctgcaccatctgtcttcatcttccgccact

SEQ ID NO: 562343 - DNA, 485 bp, Homo sapiens; identical to SEQ ID NO: 536723
  misc_feature: HIJSMM301BGBGU.5.40.D07.1.454.light.4.raw

SEQ ID NO: 562344 - DNA, 489 bp, Homo sapiens; identical to SEQ ID NO: 535139
  misc_feature: HIJSMM301BTU6O.14.55.E11.1.454.light.4.raw

SEQ ID NO: 562345 - DNA, 493 bp, Homo sapiens
  misc_feature: HIJSMM301D98V6.51.81.H04.1.454.light.4.raw
  modified_base (446)..(446): a, c, t, g, unknown or other
cgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgngaccaaggtcaccgtcctgggtcagcccaaggccaaccccactgtca

SEQ ID NO: 562346 - DNA, 499 bp, Homo sapiens
  misc_feature: HIJSMM301B5R1K.40.81.H04.1.454.light.4.raw
tctagcgactcacgaccggtgctcgatttagtagtgtagattcgcgggcgtagactttgtgtttctcgtagtctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggcctccggggtccctgacaggttcagtggcagtggatcagtcacagattttacactgaaaatcagcagggtggaggcagaagatgttgggatttattactgcatgcaacctctacaaactgtgtggacggtcggccaagggaccaaggtggaaatcaagcgaactgtggctgcaccatctgtcttcatcttccccg

SEQ ID NO: 562347 - DNA, 491 bp, Homo sapiens; identical to SEQ ID NO: 538021
  misc_feature: HIJSMM301EPWS8.3.72.G06.1.454.light.4.raw

SEQ ID NO: 562348 - DNA, 504 bp, Homo sapiens; identical to SEQ ID NO: 562185
  misc_feature: HIJSMM301DAOGD.48.35.D02.1.454.light.4.raw

SEQ ID NO: 562349 - DNA, 509 bp, Homo sapiens
  misc_feature: HIJSMM301C2540.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgttcaacagttttctcgggcgtggtccaagggaccgaaggtaggaaagtacaaacgaaactagtggcgtgcaccatctgtcttcatcttccccg

SEQ ID NO: 562350 - DNA, 488 bp, Homo sapiens; identical to SEQ ID NO: 535081
  misc_feature: HIJSMM301BIGK4.26.23.C01.1.454.light.4.raw

SEQ ID NO: 562351 - DNA, 482 bp, Homo sapiens
  misc_feature: HIJSMM301BZLXJ.22.6.A06.1.454.light.4.raw
acatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgccaaatcaatatgcttttggtatcaacagaggccaggccacgcccctgtcttaatgatatataaagacagtgagaggccctcagggatctctgagcgattctctgcctccagctcagggacaacattcacattgaccatcagtgaagtccaggcagaagatgaggctgactattattgtcaatcaacagacagtagtgggaaatatgtggtattcggcgagggaccaaactgaccgtctaggtcagcccaaggctgccccccg

SEQ ID NO: 562352 - DNA, 495 bp, Homo sapiens
  misc_feature: HIJSMM301CENEB.40.39.D06.1.454.light.4.raw
tctagcgactcacgaccggtgctcgatttagtgacatctcgcagttctttggggagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtctt

SEQ ID NO: 562353 - DNA, 512 bp, Homo sapiens
  misc_feature: HIJSMM301CH6WH.8.42.D09.1.454.light.4.raw
ctcgcgtgtccacgaccggtgctcgatttagacacatacgcagggaaagggggggtctcaggaggcagcgctctcaggacgtcaccaccatggcctgggctctactcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcggcggagggaccaagttgaccgtctaggtcagcccaaggctgccccctcggtcactctcgttcccaccctcctcg

SEQ ID NO: 562354 - DNA, 503 bp, Homo sapiens; identical to SEQ ID NO: 540136
  misc_feature: HIJSMM301CWGI3.19.10.A10.1.454.light.4.raw

SEQ ID NO: 562355 - DNA, 496 bp, Homo sapiens
  misc_feature: HIJSMM301BK0T7.11.75.G09.1.454.light.4.raw
cgagagataccacgaccggtgctcgatttagtatagacatcagggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccggttatggtatgctctggtatcaacaacgtccaggaatggcccccaaactcctcatctatgctgacaacaatcgaccttcagggtccctgaccggttctctggctccaagtctggctcttccgctccttggccatcactgggctcgaggctgacgatgaggctgattactactgtctgtcctatgacgacgacctacagactccggttttcggcggagggactaagctgaccgtctaagtcagccccaa

SEQ ID NO: 562356 - DNA, 492 bp, Homo sapiens; identical to SEQ ID NO: 536175
  misc_feature: HIJSMM301DXLN5.19.83.H06.1.454.light.4.raw

SEQ ID NO: 562357 - DNA, 509 bp, Homo sapiens
  misc_feature: HIJSMM301AU57R.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcgtccgaaggaccgaacggtaggaaagtacaaacgaacctagtggctgcaccatctgtcttcatcttccccg

SEQ ID NO: 562358 - DNA, 503 bp, Homo sapiens; identical to SEQ ID NO: 536834
  misc_feature: HIJSMM301AQHNG.2.35.D02.1.454.light.4.raw

SEQ ID NO: 562359 - DNA, 513 bp, Homo sapiens
  misc_feature: HIJSMM301AJNN6.43.3.A03.1.454.light.4.raw
tgtgagtagtcacgaccggtgctcgatttagagagcgtcacagggggtagctcaggaagcagagcctggagcatctccactatggcctgggctccactacttctcaccctcctcgctcactgcacaggttcttgggccagttttatgctgactcagccccactctgtgtcggagtctccggggaagacggtaaccatctcctgcacccgcagcggtggctttattgccagcaataatatgcagtggtaccagcagcgcccgggcagtccccccaccactgtgatctatgaggatgaccaaacgaccctctggggtcccgtaactcggttctctggctccgtcgacacctcctccaactctgcctacctcaccatctctggactgaagactgaggacgaggctgactattactgtcactcttatgatcgcaacaacagggtggttcggcggagggaccaggttgaccgtccttggtcagcccaaggctcgccccctcggtcactctcgttcccc

SEQ ID NO: 562360 - DNA, 501 bp, Homo sapiens
  misc_feature: HIJSMM301CZSMB.12.53.E09.1.454.light.4.raw
atacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggccaagctgaccgtcctgggtcagcccaaggctgcccctcggtcactctgttcccgcctctctacgtcgtat

SEQ ID NO: 562361 - DNA, 484 bp, Homo sapiens; identical to SEQ ID NO: 544691
  misc_feature: HIJSMM301B2RUY.15.1.A01.1.454.light.4.raw

SEQ ID NO: 562362 - DNA, 506 bp, Homo sapiens
  misc_feature: HIJSMM301ASZP9.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaaggtcggaaagtcaaacgaactagtggctgcaccatctgtcttcatcttccccg

SEQ ID NO: 562363 - DNA, 498 bp, Homo sapiens
  misc_feature: HIJSMM301CY8LM.52.35.D02.1.454.light.4.raw
cgcagtacgacacgaccggtgctcgatttagcacacgatagttgggtttggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtattagcaactacttagcctggtaccaacagaaacctggccaggctcccaggctcctcatctatgatgcgtccaacagggccactggcatcccagccaggttcagtggcggtgggtctgggacagacttcactctcaccatcagcagcctagagcctgaagattttgcagtttattactgtcagcagcgtagcaactggcctccgatcaccttcggccaagggacacgactggagattaaacgaactgtggctgcaccatctgtcttcat

SEQ ID NO: 562364 - DNA, 497 bp, Homo sapiens; identical to SEQ ID NO: 536371
  misc_feature: HIJSMM301AV762.16.78.H01.1.454.light.4.raw

SEQ ID NO: 562365 - DNA, 501 bp, Homo sapiens
  misc_feature: HIJSMM301A5YZ8.14.23.C01.1.454.light.4.raw
cgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagaagcaacttagcctggtaccagcagaaacctggccaggctcccaggctcctcatctatggtgcatccaccagggccactggtgtcccagccaggttcagtggcagtgggtctgggacagagttcactctcaccatcagcagcctgcagtctgaagattttgcagtttattattgtcagcagtataataactggcctccgtggacgttcggccaagggaccaaggtggaaatcaaacgaactagtggctgcaccactctgtcttcta

SEQ ID NO: 562366 - DNA, 495 bp, Homo sapiens
  misc_feature: HIJSMM301CKAPV.4.3.A03.1.454.light.4.raw
agcactgtagcacgaccggtgctcgatttagagagcgtcacagggggagaagagctgctcagttaggacccagagggaaccatggaaaccccagcgcagcttctcttcctcctgctactctggctcccagattctgccggagaagttgtcttgacgcagtctccaggcaccctgtctttgtctccaggtgaaagagccaccctctcctgccgggccagtgagagtcttagcggcgactacttagcctggtaccagcaaaaacctggccagtctcccaggctcctcatctctggtgtatccttcagggccactggcatcccagacagattcaggggcagtgggtctgggacagacttcactctcaccatcagcagactggagcctgaagactttgcgctgtatttctgtcagcagtatgttttcgcacctttcactttcggcggagggaccaaggtggagaacaaacgaactgtggctgcaccatctgtcttcatt

SEQ ID NO: 562367 - DNA, 503 bp, Homo sapiens
  misc_feature: HIJSMM301BZ01E.18.26.C04.1.454.light.4.raw
tacgagtatgcacgaccggtgctcgatttagtctagcgactttgggtttgggggggtcagacccagtcgggacacagcatggacatgagggtccccgctcagctcctggggctcctgctgctctggttcccaggttccagatgcgacatccagatgacccagtctccatcttccgtggctgccctctgtaggagacagagtcaggcatcacttgtcggacgagtcaacatattagctggttaatttggtatcagcagaaagcaggaaaagcccctaactcctgatcaagggtccgtccagtttccagagtggggcctcaacaaggttcagcggcagtggatctgggacagatttcactctcaccatcaccagcctgcagcctgaagattttgcaacttactattgtcaacaggctgacaggttcccgctgactttcggcggagggaccaaggtagagatcaaaggaactgtggctgcaccatctgtcttcatcttcccgccta

SEQ ID NO: 562368 - DNA, 498 bp, Homo sapiens; identical to SEQ ID NO: 537020
  misc_feature: HIJSMM301CQNU8.26.26.C04.1.454.light.4.raw

SEQ ID NO: 562369 - DNA, 482 bp, Homo sapiens; identical to SEQ ID NO: 535920
  misc_feature: HIJSMM301C1A41.19.71.G05.1.454.light.4.raw

SEQ ID NO: 562370 - DNA, 485 bp, Homo sapiens; identical to SEQ ID NO: 538954
  misc_feature: HIJSMM301E0AZ8.3.55.E11.1.454.light.4.raw

SEQ ID NO: 562371 - DNA, 518 bp, Homo sapiens; identical to SEQ ID NO: 539372
  misc_feature: HIJSMM301ASZ1I.7.86.H09.1.454.light.4.raw

SEQ ID NO: 562372 - DNA, 447 bp, Homo sapiens; identical to SEQ ID NO: 535020
  misc_feature: HIJSMM301A0FIC.18.9.A09.1.454.light.4.raw

SEQ ID NO: 562373 - DNA, 486 bp, Homo sapiens; identical to SEQ ID NO: 535043
  misc_feature: HIJSMM301EO1SZ.46.35.D02.1.454.light.4.raw

SEQ ID NO: 562374 - DNA, 502 bp, Homo sapiens; identical to SEQ ID NO: 536253
  misc_feature: HIJSMM301DGN11.21.22.B11.1.454.light.4.raw

SEQ ID NO: 562375 - DNA, 513 bp, Homo sapiens; identical to SEQ ID NO: 549395
  misc_feature: HIJSMM301AJL3V.17.33.C11.1.454.light.4.raw

SEQ ID NO: 562376 - DNA, 507 bp, Homo sapiens
  misc_feature: HIJSMM301C7ZC5.48.33.C11.1.454.light.4.raw
agtatacatacacgaccggtgctcgatttagagtgagctcgttgggtttgggggggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctttgaggacaacaaacgaccctccgggatccctgagagattctctggctccagctcagggacaatggccaccttgactatcaatggggcccaggtggacgatgaggctgactactactgttcctcaacagacagtagtggtgatcgagggctgttcggcggagggaccaagctgaccgtcctaagtcagcccaaggctgccccctcggtcactctgttccccg

SEQ ID NO: 562377 - DNA, 501 bp, Homo sapiens; identical to SEQ ID NO: 555551
  misc_feature: HIJSMM301B89S7.21.81.H04.1.454.light.4.raw

SEQ ID NO: 562378 - DNA, 481 bp, Homo sapiens; identical to SEQ ID NO: 535993
  misc_feature: HIJSMM301AZRB2.21.25.C03.1.454.light.4.raw

SEQ ID NO: 562379 - DNA, 473 bp, Homo sapiens; identical to SEQ ID NO: 535262
  misc_feature: HIJSMM301D1V3P.8.67.G01.1.454.light.4.raw

SEQ ID NO: 562380 - DNA, 469 bp, Homo sapiens
  misc_feature: HIJSMM301DURGH.11.70.G04.1.454.light.4.raw
cgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgcatccactctgcaatcaggggtcccatctcgattcagtggcagtggatctgggacagatttcactctcaccatcagcagcctgcagcctgaagatgttgcaacttattactgtcaaaagaatagcgctgccccgctcagtttcggcggagggaccaaggtggagataaccg

SEQ ID NO: 562381 - DNA, 524 bp, Homo sapiens
  misc_feature: HIJSMM301DIYNN.7.87.H10.1.454.light.4.raw
cgtgtctctacacgaccggtgctcgatttagcagtactgcgttgggtttggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaaatatggtactttcacccccggacgtcgtcgacggaccgaacgtaggaggtacgaaacgaacgacgtaggcgtggtcacacactgtcgttctactacttcctcctacctctcg

SEQ ID NO: 562382 - DNA, 487 bp, Homo sapiens
  misc_feature: HIJSMM301D53Q1.26.45.E01.1.454.light.4.raw
agactatactcacgaccggtgctcgatttagtgagtcagtaagggaaaggggtgatcaggactcctcagttcaccttctcacaatgaggctccctgctcagctcctggggctgctaatgctctgggtctctggatccagtggagatattgtgatggctcagtctccactctccctgcccgtcacccctggagagccggcctccatctcctgcaggtctagtcagagcgtcctgcatagtagtggatacaactatttggattggtacctgcagaagccagggcagtctccacagctcctgatctatttggcttctaatcgggcctccggggtccctgacaggttcagtggcagtggatcagacacagattttacactgaaaatcagtagagtggaggctgaggatgttggagtttattactgcatgcaagctctacaaactcctctcactttcgcggagggaccaaggtggagatcaaacgaactcgt

SEQ ID NO: 562383 - DNA, 498 bp, Homo sapiens
  misc_feature: HIJSMM301DDJGD.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcgggggaccaagctgaccgtcctaggtcagcccaaggct

SEQ ID NO: 562384 - DNA, 505 bp, Homo sapiens; identical to SEQ ID NO: 536254
  misc_feature: HIJSMM301AQQ0N.7.71.G05.1.454.light.4.raw

SEQ ID NO: 562385 - DNA, 508 bp, Homo sapiens; identical to SEQ ID NO: 556056
  misc_feature: HIJSMM301BQEG2.47.85.H08.1.454.light.4.raw

SEQ ID NO: 562386 - DNA, 486 bp, Homo sapiens
  misc_feature: HIJSMM301ERZET.3.38.D05.1.454.light.4.raw
  modified_base (480)..(480): a, c, t, g, unknown or other
agacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaaacagagttttcactacccctctcactttcggcggggggaccgaagtaggagatacaaacgaactntggctg

SEQ ID NO: 562387 - DNA, 485 bp, Homo sapiens; identical to SEQ ID NO: 542735
  misc_feature: HIJSMM301BTC1T.26.45.E01.1.454.light.4.raw

SEQ ID NO: 562388 - DNA, 484 bp, Homo sapiens; identical to SEQ ID NO: 535400
  misc_feature: HIJSMM301C69Q5.46.26.C04.1.454.light.4.raw

SEQ ID NO: 562389 - DNA, 521 bp, Homo sapiens; identical to SEQ ID NO: 539470
  misc_feature: HIJSMM301BCPUO.27.23.C01.1.454.light.4.raw

SEQ ID NO: 562390 - DNA, 485 bp, Homo sapiens
  misc_feature: HIJSMM301C4Q2H.13.8.A08.1.454.light.4.raw
tcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctcccgtgtctgcatctgtaggagacagagtcaccgtcacttgccgggcaagtcagaccattgacaaatatgtaaattggtatcaacagaagccaggtgaagcccctaagctcctgatctatactgcatccactttgtcaggcggggtcccatcaaggttccgtggcagtggatctgggacagatttcactctcaccatcaccagtctgcaacctgaagactgtgcaacttactactgccaacagtcttacggaacctcgtacacttttggccaggggaccagggctggagatcaaacgaactgtggctgcaccatctgtt

SEQ ID NO: 562391 - DNA, 489 bp, Homo sapiens
  misc_feature: HIJSMM301BDL0U.19.71.G05.1.454.light.4.raw
tactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggtccaagggaccgaaggtaggagtatcagacgaa

SEQ ID NO: 562392 - DNA, 503 bp, Homo sapiens
  misc_feature: HIJSMM301E22MP.19.67.G01.1.454.light.4.raw
tactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttctccacctccaagaacaaaaacttcttagcctggtaccaacagagaccaggacagcctcctaagttgctcatttactgggcttctacgcgcgaattcggggtccctgaccgattccggggcagcgggtctgggacagatttcactctcaccatcagcagcctgcaggctgaagatgtggcagtttattactgtcagcaatatttttcttatcctccgtggacgttggccaaggaccgagggtggaaatcagacgaactgtggctgcaccat

SEQ ID NO: 562393 - DNA, 466 bp, Homo sapiens
  misc_feature: HIJSMM301CY37L.48.59.F04.1.454.light.4.raw
agtatacatacacgaccggtgctcgatttagtacacacacttagggattggggagagctgctcagttaggacccagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcacctttcggccaagggacacgactggagattaaccgaactgtggctgcaccatctgtcttcatcttcccgccatctgatatgtatact

SEQ ID NO: 562394 - DNA, 502 bp, Homo sapiens
  misc_feature: HIJSMM301AV681.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaagtggatatcaaacgaactgtggctgcaccatctgt

SEQ ID NO: 562395 - DNA, 499 bp, Homo sapiens; identical to SEQ ID NO: 540144
  misc_feature: HIJSMM301CNUT8.47.66.F11.1.454.light.4.raw

SEQ ID NO: 562396 - DNA, 508 bp, Homo sapiens
  misc_feature: HIJSMM301DAN8Z.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaactagttttctcgggcgttcggccgaagggaccgaaggtaggaaatacaaacgaactagtggctgcaccatctgtcttcatcttccccg

SEQ ID NO: 562397 - DNA, 487 bp, Homo sapiens
  misc_feature: HIJSMM301CCSDY.17.55.E11.1.454.light.4.raw
cgtagactagcacgaccggtgctcgatttagcactcgcacgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttaatacagctccaacagtaagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttatactgtcagcaatattatagtactcctctcactttcggcggagggaccaaggtggagactcaaacgaa

SEQ ID NO: 562398 - DNA, 454 bp, Homo sapiens; identical to SEQ ID NO: 534964
  misc_feature: HIJSMM301AEIMK.19.86.H09.1.454.light.4.raw

SEQ ID NO: 562399 - DNA, 509 bp, Homo sapiens
  misc_feature: HIJSMM301AVXC5.51.55.E11.1.454.light.4.raw
cgatcgtatacacgaccggtgctcgatttagcactcgcacgttgggtttggggtgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggtttcagcagaggccaggccaatctccaagacgcctaatttataaggtttctaaccgggactctggggtcccagacagattcagcggcagtgggtcaggcactgatttcacactgataatcgacagggtggaggctgaggatgttgggttttattactgcatgcaaggtacacactggcctgggacgttcggccaagggaccaaggtggaaatacaaacgaactgtggctgcaccatctgtcttca

SEQ ID NO: 562400 - DNA, 486 bp, Homo sapiens
  misc_feature: HIJSMM301BVAIV.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcaccgtctaggtcagcccaaggccaacccca

SEQ ID NO: 562401 - DNA, 472 bp, Homo sapiens; identical to SEQ ID NO: 547391
  misc_feature: HIJSMM301AZC4B.5.70.G04.1.454.light.4.raw

SEQ ID NO: 562402 - DNA, 383 bp, Homo sapiens; identical to SEQ ID NO: 540698
  misc_feature: HIJSMM301DPNDF.41.28.C06.1.454.light.4.raw

SEQ ID NO: 562403 - DNA, 486 bp, Homo sapiens; identical to SEQ ID NO: 536261
  misc_feature: HIJSMM301A0AIE.26.55.E11.1.454.light.4.raw

SEQ ID NO: 562404 - DNA, 476 bp, Homo sapiens; identical to SEQ ID NO: 536548
  misc_feature: HIJSMM301C7BSZ.26.72.G06.1.454.light.4.raw

SEQ ID NO: 562405 - DNA, 443 bp, Homo sapiens
  misc_feature: HIJSMM301CYZ21.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctgccccctcggtcacttgttcccgccctcctccgtgtctgat

SEQ ID NO: 562406 - DNA, 499 bp, Homo sapiens
  misc_feature: HIJSMM301EKP3Q.40.42.D09.1.454.light.4.raw
tctagcgactcacgaccggtgctcgatttagacacatacgcagggaaagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagaagcattgccaaaaaatatgcttattggtaccaacagaagtcaggccaggcccctgtgctggtcatctatgaggacaacaaacgaccctccgagatccctgagagattctctggctccagctcagggacaatggccaccttggctctcagtggggcccaggtggaggatgaagctgactactactgttactcagtggacagcagtggaaatcatggggtattcggcggagggaccaagctgaccgtcctaggtcagcccaaggctgccccctcggtcta

SEQ ID NO: 562407 - DNA, 492 bp, Homo sapiens; identical to SEQ ID NO: 537666
  misc_feature: HIJSMM301DFV2N.43.33.C11.1.454.light.4.raw

SEQ ID NO: 562408 - DNA, 484 bp, Homo sapiens
  misc_feature: HIJSMM301C6Z37.48.40.D07.1.454.light.4.raw
agtatacatacacgaccggtgctcgatttagtgatagagcgtaacaacagagggggatcaggactcctcagttcaccttctcacaatgaggctccctgctcagctcctggggctgctaatgctctgggtctctggatccagtggggaaattgtgatgactcagtctccactctccctgcccgtcacccctggagagccggcctccatctcctgcaggtctagtcagagtctcctgcatagtaatggatacaattatttggattggtatttgcagaagccagggcagtctccacagctcctgatctatttgggttctaatcgggcctccggggtccctgacaggttcagtggccatggatcaggcacagatttcacactgaaaatcagcagagtggaggctgaggatgttggagtttactactgcatgcaagctctgcatactgctcggacgttcggtccaagggaccaaggtggagatcaaacg

SEQ ID NO: 562409 - DNA, 488 bp, Homo sapiens; identical to SEQ ID NO: 535568
  misc_feature: HIJSMM301A7768.21.4.A04.1.454.light.4.raw

SEQ ID NO: 562410 - DNA, 471 bp, Homo sapiens
  misc_feature: HIJSMM301EMSGR.13.39.D06.1.454.light.4.raw
tcacgtactacacgaccggtgctcgatttagtgacatctcgcgagttctttggggctgggcctcaggaagcagcatcggaggtgcctcagccatggcatggatccctctcttcctcggcgtccttgcttactgcacaggatccgtggcctcctatgagctgactcagccaccctcagtgtcccgtgtccccaggacagacagccagcatcacctgctctggaaataaattggcagataaatatacttcctggtatcagcagaagtcaggccagtccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcacgtcct

SEQ ID NO: 562411 - DNA, 511 bp, Homo sapiens
  misc_feature: HIJSMM301C1GB9.51.37.D04.1.454.light.4.raw
cgatcgtatacacgaccggtgctcgatttagtagcatactgttgggtttggggatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggtttcagcagaggccaggccaatctccaagacgcctaatttataaggtttctaaccgggactctggggtcccagacagattcagcggcagtgggtcaggcactgatttcacactgataatcgacagggtggaggctgaggatgttgggttttattactgcatgcaaggtacacactggcctgggacgttcggccaagggaccaaggtaggaaatacaaacgaactagtggctgcaccatctgtcttcatt

SEQ ID NO: 562412 - DNA, 444 bp, Homo sapiens
  misc_feature: HIJSMM301DGPKM.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgttcccaccctccttgacacgcgag

SEQ ID NO: 562413 - DNA, 467 bp, Homo sapiens
  misc_feature: HIJSMM301EKOWF.3.20.B09.1.454.light.4.raw
agacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcgtctatttaaattggtatcagcacaaaccagggaaagcccctaagctcctgatctatgctgaatccactttgcaaagtggggtcccatcaaggttcagtggcagtggatctgggacagatttcactctaaccatcagcggtctgcaacctgaagattttgcaactcactactgtcaacagagtgacagcacgcctcacactttcggcggagggaccaaggtggagatcaaacgaaa

SEQ ID NO: 562414 - DNA, 416 bp, Homo sapiens
  misc_feature: HIJSMM301BR278.16.46.E02.1.454.light.4.raw
  modified_base (404)..(404): a, c, t, g, unknown or other
tgtactactccacgaccggtgctcgatttagactcatctacagggaaagggggctgtgcctggggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaaccccactgtcactctgttccccaccctntcgagtagtaca

SEQ ID NO: 562415 - DNA, 494 bp, Homo sapiens; identical to SEQ ID NO: 540110
  misc_feature: HIJSMM301AWWN1.51.71.G05.1.454.light.4.raw

SEQ ID NO: 562416 - DNA, 501 bp, Homo sapiens
  misc_feature: HIJSMM301DZLOD.9.12.B01.1.454.light.4.raw
  modified_base (483)..(483): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcttggccaagggaccaaggtaggaaatcaaacgaactgtggctgcaccanctgtcttcatcttccccg

SEQ ID NO: 562417 - DNA, 488 bp, Homo sapiens; identical to SEQ ID NO: 535990
  misc_feature: HIJSMM301AU0Q6.11.28.C06.1.454.light.4.raw

SEQ ID NO: 562418 - DNA, 508 bp, Homo sapiens
  misc_feature: HIJSMM301BV9UH.51.50.E06.1.454.light.4.raw
cgatcgtatacacgaccggtgctcgatttagatctactgacaacacacaaggggagctgtgggctcagaagcagagttctggggtgtctccaccatggcctggacccctctctggctcactctcctcactctttgcataggttctgtggtttcctctgagctgactcaggaccccgctgtatctgtggccttgggacagacagtcaggatcacatgccaaggagacagcctcacaagttattatgcaggctggtaccagcagaagccaggacaagcccctatacttgtcctctatggtaataatcaccggccctcagggatcccagaccgattctctggctccagctcaggaaacacagcttccttgaccatcactggggctcaggcggaagatgaggctgactactactgtaattcccgggacaccagtggtcatagtggaaaccgggtcgtgttcggcggagggaccaaggtgaccgtcctgggtcagcccaaggctgtccccccg

SEQ ID NO: 562419 - DNA, 503 bp, Homo sapiens
  misc_feature: HIJSMM301CHO2T.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccgaaaatagaggtcaaacgaactgtggctgcaccatctgtcttcat

SEQ ID NO: 562420 - DNA, 498 bp, Homo sapiens
  misc_feature: HIJSMM301CU3GE.48.82.H05.1.454.light.4.raw
agtatacatacacgaccggtgctcgatttagtcgagctctctcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcacctcatatacaagcagcagcactctcgtggtattcggcgagggaccaagctgaccgtcctaggtcagcccaaggctgccccctc

SEQ ID NO: 562421 - DNA, 508 bp, Homo sapiens
  misc_feature: HIJSMM301EEEJB.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccggggccactttcggccctgggaccgaaagtggatatcaaacgaactgtggctgcaccatctgtcttcta

SEQ ID NO: 562422 - DNA, 494 bp, Homo sapiens; identical to SEQ ID NO: 534994
  misc_feature: HIJSMM301BP46V.27.78.H01.1.454.light.4.raw

SEQ ID NO: 562423 - DNA, 489 bp, Homo sapiens; identical to SEQ ID NO: 535386
  misc_feature: HIJSMM301EVK1O.12.51.E07.1.454.light.4.raw

SEQ ID NO: 562424 - DNA, 447 bp, Homo sapiens; identical to SEQ ID NO: 535020
  misc_feature: HIJSMM301A8P2S.18.9.A09.1.454.light.4.raw

SEQ ID NO: 562425 - DNA, 447 bp, Homo sapiens; identical to SEQ ID NO: 535020
  misc_feature: HIJSMM301C140V.18.9.A09.1.454.light.4.raw

SEQ ID NO: 562426 - DNA, 489 bp, Homo sapiens
  misc_feature: HIJSMM301BFZEJ.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatcgaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggataatcagacgaa

SEQ ID NO: 562427 - DNA, 503 bp, Homo sapiens; identical to SEQ ID NO: 553637
  misc_feature: HIJSMM301A2CTX.4.71.G05.1.454.light.4.raw

SEQ ID NO: 562428 - DNA, 495 bp, Homo sapiens
  misc_feature: HIJSMM301B2I0W.27.78.H01.1.454.light.4.raw
  modified_base (384)..(384): a, c, t, g, unknown or other
agcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttgggtagtagcttacactggtaccagcagaagccaggtcagtctccaaagctacctcatcaagtatgcttcccagtccttctcaggggtcccctcgaggttcagtggcagtggatctgggacacatttcaccctcaccatcaatagcctggaanctgaagatgctgcaacttattactgtcatcagagtactactttacctcaagtgatcaccttcggccaagggacacgactggagattaacgaactgtggctgcaccatctgt

SEQ ID NO: 562429 - DNA, 505 bp, Homo sapiens; identical to SEQ ID NO: 550782
  misc_feature: HIJSMM301AIHLH.11.67.G01.1.454.light.4.raw

SEQ ID NO: 562430 - DNA, 484 bp, Homo sapiens
  misc_feature: HIJSMM301BP4P4.5.45.E01.1.454.light.4.raw
atcagacacgcacgaccggtgctcgatttagtgagtcagtaagggaaagggggagtcagacccagtcaggacacagcatggacatgagggtccccgctcagctcctggggctcctgctgctctggttcccaggttccagatgcgacatccagatgacccagtctccttctttcgtgtctgcgtctgtaggagacagacttactatcgcttgtcgggcgagtcaggatattagtaccaggttagcctggtatcagcagaagcctgggagagcccctaaactcctgatctatgctgcatcaagtctgcaaagtggggtcccatcgaggttcagaggcagtggatctgggacagatttcactctcaccatcagcggcctgcagcctgaagattatgcaacttactattgtcaaagttctaatgctttcccgcgcacgttttggccaggggaccaaggtagagatcaaacgaactgtggctgcaccat

SEQ ID NO: 562431 - DNA, 492 bp, Homo sapiens
  misc_feature: HIJSMM301EA8MS.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtcgcccccccgatccaccttcggccaagggacacgactggagattaaacgaactgtggctgcaccatctgtcttcat

SEQ ID NO: 562432 - DNA, 482 bp, Homo sapiens
  misc_feature: HIJSMM301AY2CK.16.86.H09.1.454.light.4.raw
tgtactactccacgaccggtgctcgatttagtgctatagacttgggtttgggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgcatctcatatacaaccaacagcactctcgactggtattcggcggagggaccaagctgaccgtcctaggtcacgcccaaggctcgccccctcggtcactctcgttccccaccctcctcgagtagtacca

SEQ ID NO: 562433 - DNA, 513 bp, Homo sapiens
  misc_feature: HIJSMM301DVX81.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggtcggagggaccgaaactaagaggtacgaaacgaaactacgtggctgtcaccatctgtcttctatt

SEQ ID NO: 562434 - DNA, 494 bp, Homo sapiens
  misc_feature: HIJSMM301ENKMC.52.10.A10.1.454.light.4.raw
  modified_base (481)..(481): a, c, t, g, unknown or other
cgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctcttacctggcctggtaccaacaaaaacctgcccaggctcccaggctcctcatctatgatgcatccaatcgggccactggcatcccagccaggttcagtggcagtgggtctgggacagacttcactctcaccatcagcaacctagagcctgaagactttgcagtttattactgtcagcagcgtagtaagtggcgcttcggccaagggacacgactggaggttaaacgaactgtggctgcaccatctgtcttnatcttcccgccat

SEQ ID NO: 562435 - DNA, 512 bp, Homo sapiens
  misc_feature: HIJSMM301DK233.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccgaacgggaccgaaggtaggaaagtacaaaacgaacctagttggctgcaccatctgtcttcatcttccccg

SEQ ID NO: 562436 - DNA, 504 bp, Homo sapiens
  misc_feature: HIJSMM301DFLK4.19.78.H01.1.454.light.4.raw
tactctcgtgcacgaccggtgctcgatttagtgtgagtagtttgggtttgggggtgtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggcccaaccccactgt

SEQ ID NO: 562437 - DNA, 490 bp, Homo sapiens
  misc_feature: HIJSMM301EMBJ0.16.73.G07.1.454.light.4.raw
tgtactactccacgaccggtgctcgatttagctctacgctcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcaacaatattataataatccatttaatttcggcggagggaccaaggtggagatcaaacgaactgtggctgcacatctgtcttcatcttcccgcca

SEQ ID NO: 562438 - DNA, 504 bp, Homo sapiens
  misc_feature: HIJSMM301CM777.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctgggtcagccaaggctgccccctcggtcta

SEQ ID NO: 562439 - DNA, 503 bp, Homo sapiens; identical to SEQ ID NO: 535044
  misc_feature: HIJSMM301EF2I1.19.78.H01.1.454.light.4.raw

SEQ ID NO: 562440 - DNA, 501 bp, Homo sapiens; identical to SEQ ID NO: 535746
  misc_feature: HIJSMM301D0UY8.18.11.A11.1.454.light.4.raw

SEQ ID NO: 562441 - DNA, 483 bp, Homo sapiens; identical to SEQ ID NO: 561886
  misc_feature: HIJSMM301C71YF.40.83.H06.1.454.light.4.raw

SEQ ID NO: 562442 - DNA, 502 bp, Homo sapiens; identical to SEQ ID NO: 541971
  misc_feature: HIJSMM301AKVFV.4.39.D06.1.454.light.4.raw

SEQ ID NO: 562443 - DNA, 506 bp, Homo sapiens; identical to SEQ ID NO: 542696
  misc_feature: HIJSMM301D0D2M.7.71.G05.1.454.light.4.raw

SEQ ID NO: 562444 - DNA, 507 bp, Homo sapiens; identical to SEQ ID NO: 561702
  misc_feature: HIJSMM301DU8M2.5.24.C02.1.454.light.4.raw

SEQ ID NO: 562445 - DNA, 502 bp, Homo sapiens; identical to SEQ ID NO: 543442
  misc_feature: HIJSMM301A4YPQ.8.42.D09.1.454.light.4.raw

SEQ ID NO: 562446 - DNA, 481 bp, Homo sapiens
  misc_feature: HIJSMM301BUEO8.5.39.D06.1.454.light.4.raw
atcagacacgcacgaccggtgctcgatttagtgacatctcgcagttctttgggggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccaggagaggccccaaagctccttatttatgatgcctccactttgattagtggggtcccaccaacgttcagcggcagtggatctgggacagagttcactctcaccatcagcagcctgcagcctgatgatcttggaacttattactgccaacaatataatagttattggacgttcggccagggaccaaggtcgaaatgagacgaactagtggctgcacat

SEQ ID NO: 562447 - DNA, 483 bp, Homo sapiens
  misc_feature: HIJSMM301BOM95.19.57.F02.1.454.light.4.raw
tactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgcaacttattttgtcaacaggctaacacttcccctcactttcgcggaggaccaaggtggagatcaagcgaactgtggctgcaccat

SEQ ID NO: 562448 - DNA, 491 bp, Homo sapiens
  misc_feature: HIJSMM301DQ512.43.29.C07.1.454.light.4.raw
tgtgagtagtcacgaccggtgctcgatttagagtgctacgaagggaaagggggagtcagacccactcaggacacagcatggacatgagggtccccgctcagctcctggggcttctgctgctctggctcccaggtgccagatgtgccatccagttgacccagtctccatcctccctgtctgcatcagtaggagacagagtcaccatcacttgccgggcaagtcagggcattggaaccgctttagcctggtatctgcagaacccagggaaagctcctaagctcctcatctctggtgcctccactttggaaagtggggtcccatcaagattcagcggtagtggatctgggacagaattcactctcaccgtcagcagcctgcagcctgaagatttgcaacttattactgtcaacagtttaataactacctctcactttcggaggagggaccagggtggagatcaaacgaactgtggctgcaccatctgtcttcta

SEQ ID NO: 562449 - DNA, 473 bp, Homo sapiens
  misc_feature: HIJSMM301B3Y9P.49.37.D04.1.454.light.4.raw
agtcgagagacacgaccggtgctcgatttagtagcatactgttgggtttggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcatcacctactatttaaattggtatcagcaaaacccagggaaagcccctaagctcctgatctatgctgcatccaatctgcaaagtggggtcccatcaaggttcagtggcagtggatctgggacagatttcaccctcaccatcagcagtctgcaacctgatgattttgcaacttattattgtcaacagagttacagtatccgtacacttttggccagggaccaggctggatatcagacgaactgtggctgca

SEQ ID NO: 562450 - DNA, 485 bp, Homo sapiens
  misc_feature: HIJSMM301ECS90.4.41.D08.1.454.light.4.raw
agcactgtagcacgaccggtgctcgatttagtcacgcgagaaagggaaagggggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcgggcgagtcaggatattagtaccaacttagcctggtatcagcagaagcctgggcgagcccctaaactcctgatctatggtgcatcaagtctgcaaagtggggtcccatcgaggttcagaggcagtggatctgggacagatttcactctcaccatcagcggcctgcagcctgaagattatgcaaacttactattgtcagagttctaattctttcccgcgcacgtttggccaggggaccaaggtagagatcaaacgaactgtggctgcaccat

SEQ ID NO: 562451 - DNA, 505 bp, Homo sapiens; identical to SEQ ID NO: 535987
  misc_feature: HIJSMM301AKX6D.18.37.D04.1.454.light.4.raw

SEQ ID NO: 562452 - DNA, 504 bp, Homo sapiens; identical to SEQ ID NO: 561069
  misc_feature: HIJSMM301AW3M8.19.78.H01.1.454.light.4.raw

SEQ ID NO: 562453 - DNA, 488 bp, Homo sapiens; identical to SEQ ID NO: 553834
  misc_feature: HIJSMM301EQ8QG.17.35.D02.1.454.light.4.raw

SEQ ID NO: 562454 - DNA, 491 bp, Homo sapiens
  misc_feature: HIJSMM301DL8BH.12.23.C01.1.454.light.4.raw
atacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaagagccaccctctcctgcagggccagtcagagtgttaatagcgacttagcctggtaccagcagatacctggccaggctcccaggctcctcatctatggtgcatctaccagggccactggtatcccagccaggttcagtggcagtgggtctgggacagagttcactctcaccatcagcagcctgcagtctgaagattttgctgtttattactgtcagcagtataataactggttcctgctcactttcggcgggggaccgaaggtggagatcaaacgaactgtggctgcaccatct

SEQ ID NO: 562455 - DNA, 485 bp, Homo sapiens; identical to SEQ ID NO: 536040
  misc_feature: HIJSMM301AXFN1.15.1.A01.1.454.light.4.raw

SEQ ID NO: 562456 - DNA, 504 bp, Homo sapiens; identical to SEQ ID NO: 538940
  misc_feature: HIJSMM301AK0CQ.2.35.D02.1.454.light.4.raw

SEQ ID NO: 562457 - DNA, 476 bp, Homo sapiens; identical to SEQ ID NO: 548126
  misc_feature: HIJSMM301DU0BW.4.10.A10.1.454.light.4.raw

SEQ ID NO: 562458 - DNA, 505 bp, Homo sapiens; identical to SEQ ID NO: 536117
  misc_feature: HIJSMM301D84R7.8.71.G05.1.454.light.4.raw

SEQ ID NO: 562459 - DNA, 483 bp, Homo sapiens
  misc_feature: HIJSMM301CRBX9.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtcctgacaggttcagtggcagtggatcaggcacagattttacactgaaaatcagcagagtggaggctgaggatgttgggctctattattgcatgcaagctctacaagtcccgctcactttcggcggagggaccaaggtggagatcaaacgaa

SEQ ID NO: 562460 - DNA, 492 bp, Homo sapiens; identical to SEQ ID NO: 535126
  misc_feature: HIJSMM301EM3AU.18.11.A11.1.454.light.4.raw

SEQ ID NO: 562461 - DNA, 494 bp, Homo sapiens; identical to SEQ ID NO: 534992
  misc_feature: HIJSMM301DKWPD.9.1.A01.1.454.light.4.raw

SEQ ID NO: 562462 - DNA, 509 bp, Homo sapiens
  misc_feature: HIJSMM301C9RNX.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtccccccggacgttcgccacgggaccgaccgagtagaaatagagacgaactagtggcgtgcaccatctgtcttctatcttcccgt

SEQ ID NO: 562463 - DNA, 495 bp, Homo sapiens; identical to SEQ ID NO: 536020
  misc_feature: HIJSMM301AIXGN.41.38.D05.1.454.light.4.raw

SEQ ID NO: 562464 - DNA, 483 bp, Homo sapiens
  misc_feature: HIJSMM301BJES3.5.39.D06.1.454.light.4.raw
atcagacacgcacgaccggtgctcgatttagtgacatctcgcagttctttggggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccaggagaggccccaaagctccttatttatgatgcctccactttgattagtggggtcccaccaacgttcagcggcagtggatctgggacagagttcactctcaccatcagcagcctgcagcctgatgatcttggaacttattactgccaacaatataatagttaattggacgttcggccaggggaccaaggtcgaaatgaagacgaactgtggctgcaccat

SEQ ID NO: 562465 - DNA, 497 bp, Homo sapiens; identical to SEQ ID NO: 535664
  misc_feature: HIJSMM301B1W6O.22.14.B03.1.454.light.4.raw

SEQ ID NO: 562466 - DNA, 487 bp, Homo sapiens; identical to SEQ ID NO: 536536
  misc_feature: HIJSMM301CL3E5.26.45.E01.1.454.light.4.raw

SEQ ID NO: 562467 - DNA, 447 bp, Homo sapiens; identical to SEQ ID NO: 535201
  misc_feature: HIJSMM301CS7T1.18.9.A09.1.454.light.4.raw

SEQ ID NO: 562468 - DNA, 486 bp, Homo sapiens; identical to SEQ ID NO: 535043
  misc_feature: HIJSMM301AQLOJ.46.35.D02.1.454.light.4.raw

SEQ ID NO: 562469 - DNA, 513 bp, Homo sapiens; identical to SEQ ID NO: 556428
  misc_feature: HIJSMM301DP7BP.15.34.D01.1.454.light.4.raw

SEQ ID NO: 562470 - DNA, 494 bp, Homo sapiens; identical to SEQ ID NO: 534992
  misc_feature: HIJSMM301EVUKF.9.1.A01.1.454.light.4.raw

SEQ ID NO: 562471 - DNA, 493 bp, Homo sapiens; identical to SEQ ID NO: 535745
  misc_feature: HIJSMM301DQ1PH.47.78.H01.1.454.light.4.raw

SEQ ID NO: 562472 - DNA, 492 bp, Homo sapiens
  misc_feature: HIJSMM301BMYOY.49.42.D09.1.454.light.4.raw
agtcgagagacacgaccggtgctcgatttagacacatacgcagggaaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtcgttataactttgtctcctggtaccagcaacacccaggcaaggcccccaaactcttcatttatgatgtcactaatcggccctcaggggtccctgatcgcttctctgcctccaagtctggcaacacggcctccctgaccatctctgggctccaggctgaggatgaggctcattattattgttgctcatatgcaggcaacttcgcttttgtcttcggaactgggaccgaggtcaccgtctgggtcagcccaagg

SEQ ID NO: 562473 - DNA, 518 bp, Homo sapiens; identical to SEQ ID NO: 543797
  misc_feature: HIJSMM301EV99C.19.80.H03.1.454.light.4.raw

SEQ ID NO: 562474 - DNA, 507 bp, Homo sapiens; identical to SEQ ID NO: 549050
  misc_feature: HIJSMM301ANM1O.18.37.D04.1.454.light.4.raw

SEQ ID NO: 562475 - DNA, 522 bp, Homo sapiens
  misc_feature: HIJSMM301CXV4A.16.85.H08.1.454.light.4.raw
tgtactactccacgaccggtgctcgatttagtatcactcagtcgcggggctgggcctaaggaagcagcactggtggtgcctcagccatggcctggaccgttctcctcctcggcctcctctctcactgcacaggctctgtgacctcctatgtgctgactcagccaccctcggtgtcgttggccccaggacagacggccttaataacctgtggggaagcaacattggaagcaaaaatgtgcactggtacatgcagaggccaggccaggcccctgttttggtcgtctatgatgataccgagcggccctcagggatccctgagcgattctccggctccaactctggtgacacggccaccctgaccatcaacagggtcgaagtcggggatgaggccgactattactgtcaggtgtgggatggtgttagtgatcgggcacttttcggtcggagggacccgagctgaccgtcctaggtcagcccaacggctgccccctccggtcactctgttcccaccctcctcgacgt

SEQ ID NO: 562476 - DNA, 483 bp, Homo sapiens; identical to SEQ ID NO: 550472
  misc_feature: HIJSMM301DYLNC.49.83.H06.1.454.light.4.raw

SEQ ID NO: 562477 - DNA, 505 bp, Homo sapiens
  misc_feature: HIJSMM301AI0HH.16.49.E05.1.454.light.4.raw
tgtactactccacgaccggtgctcgatttagagcgactagcaacacacaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttgggggttataaccttgtctcctggtaccagcagcacccagacaaagcccccaaactcatgatttatgagggcaataagcggccctcaggagtttctaatcgcttctctggctccacgtctggcaacacggcctccctgacaatctctggcctccaggctgaggacgaggctgattattactgctgctcatattcaagtcgtgtcactatgctttttggcggtagggaccaaggtgaccgtcctaggtcagcccaaggctgtccccccg

SEQ ID NO: 562478 - DNA, 471 bp, Homo sapiens; identical to SEQ ID NO: 554069
  misc_feature: HIJSMM301AQPTB.12.7.A07.1.454.light.4.raw

SEQ ID NO: 562479 - DNA, 479 bp, Homo sapiens; identical to SEQ ID NO: 535531
  misc_feature: HIJSMM301B2SEK.41.17.B06.1.454.light.4.raw

SEQ ID NO: 562480 - DNA, 498 bp, Homo sapiens
  misc_feature: HIJSMM301AEFVO.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcagggtacgactcctggccggttcctactttcgttcgacgggaccggaaacctaagagtaatacagacgaacgaagt

SEQ ID NO: 562481 - DNA, 442 bp, Homo sapiens
  misc_feature: HIJSMM301DWXJH.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcatttcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgccccctcggtcactctgttcccaccctcctcgtatctctcg

SEQ ID NO: 562482 - DNA, 504 bp, Homo sapiens; identical to SEQ ID NO: 544859
  misc_feature: HIJSMM301BHKF7.15.66.F11.1.454.light.4.raw

SEQ ID NO: 562483 - DNA, 513 bp, Homo sapiens; identical to SEQ ID NO: 539678
  misc_feature: HIJSMM301D4QW9.17.37.D04.1.454.light.4.raw

SEQ ID NO: 562484 - DNA, 496 bp, Homo sapiens; identical to SEQ ID NO: 537925
  misc_feature: HIJSMM301A0JKA.22.14.B03.1.454.light.4.raw

SEQ ID NO: 562485 - DNA, 447 bp, Homo sapiens; identical to SEQ ID NO: 535201
  misc_feature: HIJSMM301B75ZE.18.9.A09.1.454.light.4.raw

SEQ ID NO: 562486 - DNA, 493 bp, Homo sapiens; identical to SEQ ID NO: 544835
  misc_feature: HIJSMM301BMHIR.43.29.C07.1.454.light.4.raw

SEQ ID NO: 562487 - DNA, 486 bp, Homo sapiens
  misc_feature: HIJSMM301BG5YC.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaaggggccaaggtggatatcagacgaa

SEQ ID NO: 562488 - DNA, 447 bp, Homo sapiens; identical to SEQ ID NO: 535201
  misc_feature: HIJSMM301A73HI.18.9.A09.1.454.light.4.raw

SEQ ID NO: 562489 - DNA, 484 bp, Homo sapiens; identical to SEQ ID NO: 535400
  misc_feature: HIJSMM301DNMBY.46.26.C04.1.454.light.4.raw

SEQ ID NO: 562490 - DNA, 504 bp, Homo sapiens; identical to SEQ ID NO: 540089
  misc_feature: HIJSMM301DITXU.3.53.E09.1.454.light.4.raw

SEQ ID NO: 562491 - DNA, 502 bp, Homo sapiens
  misc_feature: HIJSMM301BU7QM.51.14.B03.1.454.light.4.raw
cgatcgtatacacgaccggtgctcgatttagtgtgagtagttccgcggggaggagtcagaccccgtcgggacacagcatggacatgagggtccccgctcagctcctggggctcctgctgctctggttcccaggttccagatgcgacatccagatgacccagtctccatcctccgtgtctgcatctgtaggagacagagtcaccatgacttgtcgggcgagtcagggtattgacgactacttagcctggcttcagcagaaaccagggaaagcccccaagctcttgatctatgctgcatccaggttggaaagtggggtcccatcaaggttcagcggcagtggatctgggacagatttcactctcaccatcagcagcctgcagcctgaagattttgcaacttattattgtcaacaggctaaaagttaccctctcactttcggcggagggaccaaggtagaaaccaaacgaactagtggctgcaccatctgtcttcatcttccccg

SEQ ID NO: 562492 - DNA, 490 bp, Homo sapiens; identical to SEQ ID NO: 535526
  misc_feature: HIJSMM301B8Y14.26.78.H01.1.454.light.4.raw

SEQ ID NO: 562493 - DNA, 423 bp, Homo sapiens
  misc_feature: HIJSMM301A4BNA.41.14.B03.1.454.light.4.raw
tctatactatcacgaccggtgctcgatttagtgtgagtagttccgcgggcacgaccggtgctcgatttagtgtgagtagtttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgctaatttattactgtcaccagtatggtagttcacctctaactttcggcggagggaccaaggtggagatcaaacgaactgtggctgcaccatctgtcttcatcttcccgccatctgaatagtataga

SEQ ID NO: 562494 - DNA, 511 bp, Homo sapiens; identical to SEQ ID NO: 552076
  misc_feature: HIJSMM301CE2I0.17.33.C11.1.454.light.4.raw

SEQ ID NO: 562495 - DNA, 511 bp, Homo sapiens
  misc_feature: HIJSMM301C52IV.17.28.C06.1.454.light.4.raw
cgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagccctccctgaccatcagtgggctccggtccgaggatgaggctgattattactgtgcaccgtgggatgacatcctgaatggtccggtgttcggcggagggaccaggctgaccgtcctaagtcagcccaaggctcgccccctc

SEQ ID NO: 562496 - DNA, 503 bp, Homo sapiens; identical to SEQ ID NO: 538192
  misc_feature: HIJSMM301AZY10.47.65.F10.1.454.light.4.raw

SEQ ID NO: 562497 - DNA, 489 bp, Homo sapiens; identical to SEQ ID NO: 546040
  misc_feature: HIJSMM301BUNI5.11.12.B01.1.454.light.4.raw

SEQ ID NO: 562498 - DNA, 494 bp, Homo sapiens; identical to SEQ ID NO: 534994
  misc_feature: HIJSMM301EWA9V.27.78.H01.1.454.light.4.raw

SEQ ID NO: 562499 - DNA, 487 bp, Homo sapiens; identical to SEQ ID NO: 550345
  misc_feature: HIJSMM301DNLLI.14.68.G02.1.454.light.4.raw

SEQ ID NO: 562500 - DNA, 477 bp, Homo sapiens
  misc_feature: HIJSMM301BXT40.48.38.D05.1.454.light.4.raw
agtatacatacacgaccggtgctcgatttagtatctgatagttgggtttgggggcagcttctcttcctcctgctactctggctcccagataccaccggagcacttgtgttgacgcagtctccaggcaccctgtctttgtctccaggggagagagccaccctctcctgcagggccagtcagagtgttagcggcggctccgtagcctggtaccagcagaaacgtggccaggttcccaggctcctcatctatgatgcatccagcagggccactggcatcccagacaggttcagtggcagtgggtctgggacagacttcactctcaccatcagcagactggagcctgaagattttgcagtgtattactgtcagcagtatggtagctcacctcaactcactttcggcggagggaccaaggtggagatcaacgaactgtggctgcaccatctgtcttcatcttcccgccatctgatatgtata

SEQ ID NO: 562501 - DNA, 498 bp, Homo sapiens; identical to SEQ ID NO: 535974
  misc_feature: HIJSMM301BFA8T.22.27.C05.1.454.light.4.raw

SEQ ID NO: 562502 - DNA, 509 bp, Homo sapiens
  misc_feature: HIJSMM301ADV3X.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaacggtaggaaagtacaaacgaactagtggctgcaccactctgtcttcatcttccccg

SEQ ID NO: 562503 - DNA, 488 bp, Homo sapiens
  misc_feature: HIJSMM301ELQDW.3.55.E11.1.454.light.4.raw
agacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtatcccagccaggttcagtggcagtgggtctgggacagagttcattctcaccatcagcagcctgcagtctgaagattttgcaatttattactgtcagcagtataataactggtggacgttcggccaagggaccaaggtagaaatcaaacgaactgtaggctgcaccatctgt

SEQ ID NO: 562504 - DNA, 511 bp, Homo sapiens
  misc_feature: HIJSMM301EZQ00.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccgggggccactttcggccctcgggaccgaaagtaggatatcaaacgaactgtggctgcaccatctgtcttcta

SEQ ID NO: 562505 - DNA, 482 bp, Homo sapiens
  misc_feature: HIJSMM301D70WV.49.53.E09.1.454.light.4.raw
agtcgagagacacgaccggtgctcgatttagagagagtgtgttgggtttggggctgtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagactttgagagggcctcagggacccctgagcgattctctggctccagctcagcgacaacagtcacgttgaccatcagtggagtccgggcagaggacgaggctgactattactgtcagtcatcagacagtagtggcacttctgtcgtattcggcggagggaccaagctgaccgtcctaggtcagcccaa

SEQ ID NO: 562506 - DNA, 475 bp, Homo sapiens; identical to SEQ ID NO: 537714
  misc_feature: HIJSMM301CY3JH.7.81.H04.1.454.light.4.raw

SEQ ID NO: 562507 - DNA, 488 bp, Homo sapiens
  misc_feature: HIJSMM301DK93S.11.28.C06.1.454.light.4.raw
cgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggtttcagcagaggccaggccaatctccaaggcgcctaatttataaggtttctaggcgggactctggggtcccagacagattcagcggcagtgggtcaggcgctgatttcacactgagaatcagcagggtggaggctgaagatgtcggggtttattactgcatgcagggtacagtgtgggccttcgctcgcattcggcggagggaccaaggtggagatcaacgaa

SEQ ID NO: 562508 - DNA, 484 bp, Homo sapiens
  misc_feature: HIJSMM301EORC0.16.81.H04.1.454.light.4.raw
tgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaactttcggccctgggaccaatagtggatatcaaacgaactagtggctgcaccatctgtctt

SEQ ID NO: 562509 - DNA, 489 bp, Homo sapiens; identical to SEQ ID NO: 561039
  misc_feature: HIJSMM301C5NHV.10.59.F04.1.454.light.4.raw

SEQ ID NO: 562510 - DNA, 514 bp, Homo sapiens
  misc_feature: HIJSMM301B9B22.15.34.D01.1.454.light.4.raw
tctacgtagccacgaccggtgctcgatttagatcgtctgtgttgggtttgggggaagcctgagaacacttagccttcatgagtgtccccacccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtggggcgtggcatttgggtgttcggcggagggaccaaactgaccgtcctaggtcagcccaaggctgccccctcggtcactctcg

SEQ ID NO: 562511 - DNA, 485 bp, Homo sapiens
  misc_feature: HIJSMM301DO4HN.22.6.A06.1.454.light.4.raw
acatacgcgtcacgaccggtgctcgatttagatctactgacagggggtgggtccaggaggcagaactctgggtagtctcaccatggcctggatccctctacttctccccctcctcactctctgcacagactctgaggccgcctatgagctgacacagccaccctcggtgtcagtgtccccaggacagacggccagaatcacctgctctggagatgcactgccaaatcaatatgctttttggtatcaacagaggccaggccacgcccctgtcttaatgatatataaagacagtgagaggccctcagggatctctgagcgattctctgcctccagctcagggacaacattcacattgaccatcagtgaagtccaggcagaagatgaggctgactattattgtcaatcaacagacagtagtgggaaatatgtggtattcggcggagggaccaaactgaccgtcctaggtcagcccaaggctgcccccc

SEQ ID NO: 562512 - DNA, 506 bp, Homo sapiens
  misc_feature: HIJSMM301A6SQ8.43.15.B04.1.454.light.4.raw
tgtgagtagtcacgaccggtgctcgatttagacagtatatatccgcgggggaggaactgctcagttaggacccagacggaaccatggaagccccagcgcagcttctcttcctcctgctactctggctcccagaaaccactggagaaatagtgatgacgcagtctccagccaccctgtctttgtctccaggggaaagagccaccctctcatgcagggccagtcagagtgttagcaccaacgtggcctggtaccagcagaaacctggccagcctccccggctcctcatctctggtgcatcctccagggccactggttccccagccaggttcagtggcagtgggtctgggacagagttcactctcaccatcagcagccttcagtctgaagattttgcagtttattactgtcaccagtatcataactggcctccaagggggactttcggccaagggaccaaggtaggaatctaacgaactgtggctgcaccatctgtcttcatcttcccg

SEQ ID NO: 562513 - DNA, 492 bp, Homo sapiens
  misc_feature: HIJSMM301DK7B9.49.20.B09.1.454.light.4.raw
agtcgagagacacgaccggtgctcgatttagtgtagtgtgaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaacaatatgcttactggtaccagcagaggccaggccaggcccctgtcttggtgatttataaagactttgagaggccctcagggacccctgagcgattctctggctccagctcagggacaacagtcaccttgaccatcagtggagtccggccagaggacgaggctgactattactgtcagtccgcagacagcagtggcagttatgtcgtattcggcggagggactagctgaccgtcctaggtcagcccaaggctgccccctcggtcactc

SEQ ID NO: 562514 - DNA, 354 bp, Homo sapiens; identical to SEQ ID NO: 535026
  misc_feature: HIJSMM301AMZIU.19.22.B11.1.454.light.4.raw

SEQ ID NO: 562515 - DNA, 447 bp, Homo sapiens; identical to SEQ ID NO: 535020
  misc_feature: HIJSMM301DMRYL.18.9.A09.1.454.light.4.raw

SEQ ID NO: 562516 - DNA, 500 bp, Homo sapiens; identical to SEQ ID NO: 546095
  misc_feature: HIJSMM301AWC4L.52.78.H01.1.454.light.4.raw

SEQ ID NO: 562517 - DNA, 513 bp, Homo sapiens
  misc_feature: HIJSMM301C4XOW.40.12.B01.1.454.light.4.raw
tctagcgactcacgaccggtgctcgatttagtagtgtagattccgcgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcaagtgacgttggtggttataactatgtctcctggtaccaactacacccaggcaaagcccccaaactcatgatttctgacgtcagtaagcggccctcaggggtccctgatcgcttctctggctccaagtctggcaacacggcctccctgaccgtctctgggctccaggctgaagatgaggctgattattactgctactcgtatgcaggcggcaacaattgggtcttcggcggagggaccaagctgaccgtctaggtcagcccaaggctgccccctcggtcactctgttcccg

SEQ ID NO: 562518 - DNA, 518 bp, Homo sapiens
  misc_feature: HIJSMM301EW4OY.48.17.B06.1.454.light.4.raw
agtatacatacacgaccggtgctcgatttagtcgatagtgaaggggggggtcgacaagaggcagcgctctcgggacgtctccaccatggcctgggctctgctgctcctcaccctcctcactcaggacacagggtcctgggcccaggctgccctgactcagccagcctccgtgtctgcctctcctggacagtcggtcaatctttcctgcactggaaccgcctatgacattggaaaatataaccttgtctcctggtaccagcaacacccaggcaaagcccccaaattaattatttatacggtcaataagagaccgtcaggggtctctgctcgcttctctgggtccaagtctggcgacacggcctccctcacaatctctgggctccaggctgacgacgaggcttcctattgctgctcctcatatgtaggatccggctcttatctgattttcggcggagggaccaagctgaccgtcctacgtcagcccaaggctgccccctcggtcactctgttcccgccct

SEQ ID NO: 562519 - DNA, 375 bp, Homo sapiens; identical to SEQ ID NO: 537938
  misc_feature: HIJSMM301BS3HC.9.11.A11.1.454.light.4.raw

SEQ ID NO: 562520 - DNA, 514 bp, Homo sapiens; identical to SEQ ID NO: 541634
  misc_feature: HIJSMM301AW96K.10.80.H03.1.454.light.4.raw

SEQ ID NO: 562521 - DNA, 494 bp, Homo sapiens; identical to SEQ ID NO: 534994
  misc_feature: HIJSMM301EXR55.27.78.H01.1.454.light.4.raw

SEQ ID NO: 562522 - DNA, 511 bp, Homo sapiens; identical to SEQ ID NO: 537464
  misc_feature: HIJSMM301EPDEB.7.34.D01.1.454.light.4.raw

SEQ ID NO: 562523 - DNA, 501 bp, Homo sapiens
  misc_feature: HIJSMM301ENWWT.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaaccccac

SEQ ID NO: 562524 - DNA, 486 bp, Homo sapiens; identical to SEQ ID NO: 535043
  misc_feature: HIJSMM301BA9HZ.46.35.D02.1.454.light.4.raw

SEQ ID NO: 562525 - DNA, 510 bp, Homo sapiens; identical to SEQ ID NO: 535474
  misc_feature: HIJSMM301CI1LB.17.33.C11.1.454.light.4.raw

SEQ ID NO: 562526 - DNA, 485 bp, Homo sapiens; identical to SEQ ID NO: 536210
  misc_feature: HIJSMM301CBO12.43.54.E10.1.454.light.4.raw

SEQ ID NO: 562527 - DNA, 441 bp, Homo sapiens; identical to SEQ ID NO: 550529
  misc_feature: HIJSMM301B9GRL.41.9.A09.1.454.light.4.raw

SEQ ID NO: 562528 - DNA, 494 bp, Homo sapiens
  misc_feature: HIJSMM301D75B6.19.71.G05.1.454.light.4.raw
tactctcgtgcacgaccggtgctcgatttagtgtcgtcgcaagagagaggggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaactgtgg

SEQ ID NO: 562529 - DNA, 482 bp, Homo sapiens; identical to SEQ ID NO: 535352
  misc_feature: HIJSMM301BDJOX.16.81.H04.1.454.light.4.raw

SEQ ID NO: 562530 - DNA, 493 bp, Homo sapiens
  misc_feature: HIJSMM301BOB0V.49.15.B04.1.454.light.4.raw
agtcgagagacacgaccggtgctcgatttagacagtatatatccgcgggcacgaccggtgctcgatttagagtgctacgaagggaaaggggaagagctgctcagttaggacccagagggaaccatggaaaccccagcgcagcttctcttcctcctgctactctggctcccagataccaccgcagaaattgtgttgacgcagtctccaggcaccctgtctttgtctccaggggaaagagccaccctctcctgcagggccagtcagagcgttagcaacagttatgtagcctggtaccagcagaaacctggccagtctcccaggctcctcatctatgctgcgtccagcagggccactggcatcccggacaggttcagtggcagtgggtctgggacagacttctctctcaccatcagcagactggagcctgaagattttgcagtatattactgtcagcatgggagcattcgtgcgctcaccttcggcggagggaccg

SEQ ID NO: 562531 - DNA, 497 bp, Homo sapiens
  misc_feature: HIJSMM301CL0RA.16.75.G09.1.454.light.4.raw
tgtactactccacgaccggtgctcgatttagtatagacatcaggggggggtcgtcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgtaggtcgttataactatgtctcctggtaccaacaacacccaggcaacgcccccacggctcatgatttatgaggtcaatgatcggccctcaggaatttccaatcgcttctctggctccaagtctggcaacacggcctccctgacaatctctgacctcccagcctgaggacgaggctgaatattactgcagttcatatacaactaagagtcttgtggtattcggcggagggaccaagctgacagtcctaggtcagcccaaggctgccccctc

SEQ ID NO: 562532 - DNA, 353 bp, Homo sapiens; identical to SEQ ID NO: 536338
  misc_feature: HIJSMM301AD3AE.3.11.A11.1.454.light.4.raw

SEQ ID NO: 562533 - DNA, 520 bp, Homo sapiens; identical to SEQ ID NO: 537173
  misc_feature: HIJSMM301DVLY3.27.23.C01.1.454.light.4.raw

SEQ ID NO: 562534 - DNA, 488 bp, Homo sapiens; identical to SEQ ID NO: 543314
  misc_feature: HIJSMM301D657L.3.33.C11.1.454.light.4.raw

SEQ ID NO: 562535 - DNA, 479 bp, Homo sapiens; identical to SEQ ID NO: 540569
  misc_feature: HIJSMM301DER59.5.70.G04.1.454.light.4.raw

SEQ ID NO: 562536 - DNA, 500 bp, Homo sapiens; identical to SEQ ID NO: 536183
  misc_feature: HIJSMM301B1YDV.10.17.B06.1.454.light.4.raw

SEQ ID NO: 562537 - DNA, 493 bp, Homo sapiens; identical to SEQ ID NO: 537422
  misc_feature: HIJSMM301AUVDP.9.34.D01.1.454.light.4.raw

SEQ ID NO: 562538 - DNA, 499 bp, Homo sapiens
  misc_feature: HIJSMM301DSJ2X.14.59.F04.1.454.light.4.raw
cgtctagtaccacgaccggtgctcgatttagtacacacacttagggattgggggatcaggactcctcagttcaccttctcacaatgaggctccctgctcagctcctggggctgctaatgctctgggtctctggatccagtggggatattgtgatgactcagtctccactttccctgaccgtcacccctggagagccggcctccatctcctgcaggtctagtcagagcctcctgcatactaatggaaacaactttttggattggtacctgcagaagccagggcagtctccacagctcctgatctatttgggttctaatcgggcctccggagtccctgacaggttcagtggcagtggatcaggcacagattttacactgaaaatcagcagagtggaggctgaggatgttggggtttattactgcatgcaagctctacaaactcgaacgttcggccaagggaccaaggtggaaatcaaacgactgtggctgcaccatctgtt

SEQ ID NO: 562539 - DNA, 503 bp, Homo sapiens
  misc_feature: HIJSMM301AQ58D.19.78.H01.1.454.light.4.raw
tactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccactgtc

SEQ ID NO: 562540 - DNA, 519 bp, Homo sapiens; identical to SEQ ID NO: 546594
  misc_feature: HIJSMM301AGXIQ.8.87.H10.1.454.light.4.raw

SEQ ID NO: 562541 - DNA, 482 bp, Homo sapiens; identical to SEQ ID NO: 540521
  misc_feature: HIJSMM301AGT27.21.25.C03.1.454.light.4.raw

SEQ ID NO: 562542 - DNA, 383 bp, Homo sapiens; identical to SEQ ID NO: 447524
  misc_feature: HIJSMM301AHGMI.41.26.C04.1.454.light.4.raw

SEQ ID NO: 562543 - DNA, 501 bp, Homo sapiens; identical to SEQ ID NO: 540528
  misc_feature: HIJSMM301AVEPQ.11.31.C09.1.454.light.4.raw

SEQ ID NO: 562544 - DNA, 480 bp, Homo sapiens
  misc_feature: HIJSMM301D58F6.13.48.E04.1.454.light.4.raw
tcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaagtggggtcccatcaaggttcagcggcagtggatctggcacagacttcattctcaccatcagcagcctgcagcctgaagattttgcaacttattactgtctacaagatcacaattatcctgggacgttcggccaagggaccaaggtggaaagtcaaacgaactagtgg

SEQ ID NO: 562545 - DNA, 479 bp, Homo sapiens
  misc_feature: HIJSMM301DIN0X.26.70.G04.1.454.light.4.raw
agactatactcacgaccggtgctcgatttagtgtagtgtgaagggaaagggggcaggaatcagacccagtcaggacacagcatggacatgagagtcctcgctcagctcctggggctcctgctgctctgtttcccaggtgccagatgtgacatccagatgacccagtcgccatcctcactgtctgcctctgtaggagacagagtcaccatcacttgtcgggcgagtcagggcattagcgattttttagcctggtttcagcagaaaccagggaaagcccccaagtccctgatctatgctgcgtccactttagaaggtggagtcccatcaaggttcagcggcagtggatctgggacagagttcactctcaacatcagcagcctgcagcctgaggattttgcaacttatactgccagcagtataatgattaccctatcaccttcggccgggggacacggctggaaactaaacgaactgtggtc

SEQ ID NO: 562546 - DNA, 495 bp, Homo sapiens
  misc_feature: HIJSMM301C88IK.22.86.H09.1.454.light.4.raw
acatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgaccgtcctaggtcagcccaaggctgccccctggtcactctgttcccaccctcct

SEQ ID NO: 562547 - DNA, 487 bp, Homo sapiens; identical to SEQ ID NO: 541889
  misc_feature: HIJSMM301ANFH5.26.23.C01.1.454.light.4.raw

SEQ ID NO: 562548 - DNA, 444 bp, Homo sapiens; identical to SEQ ID NO: 535856
  misc_feature: HIJSMM301A8I9S.9.9.A09.1.454.light.4.raw

SEQ ID NO: 562549 - DNA, 486 bp, Homo sapiens; identical to SEQ ID NO: 537238
  misc_feature: HIJSMM301ENG7C.19.71.G05.1.454.light.4.raw

SEQ ID NO: 562550 - DNA, 500 bp, Homo sapiens
  misc_feature: HIJSMM301BT4SU.18.59.F04.1.454.light.4.raw
tacgagtatgcacgaccggtgctcgatttagtacacacacttagggattggggggggtctcaggaggcagcgctctcgggacgtctccaccatggcccgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtctaggtcagcccaaggccaaccc

SEQ ID NO: 562551 - DNA, 478 bp, Homo sapiens
  misc_feature: HIJSMM301BTESH.48.53.E09.1.454.light.4.raw
agtatacatacacgaccggtgctcgatttagagagagtgtgttgggtttgggggtggtagctcaggaagcagagcctggagcatctccactatggcctgggctccactacttctcaccctcctcgctcactgcacaggttcttgggcccattttatgctgactcagccccactctgtgtcggagtctccggggaagacggtgaccatctcctgcacccgcagcagtggcagcgttgccaccaactatgtgcagtggttccagcagcgcccgggcagttcgcccatcactgtgatctatgagaataatgagagaccctctggggtccccgatcggttctctggctccatcgacaggtcctccaactctgcctctctcaccatctctggactgcagactgaggacgaggctgattactactgtcagtcttatgatagtggcaataatgttgggtgttggcggaggccaagctgaccgtct

SEQ ID NO: 562552 - DNA, 520 bp, Homo sapiens; identical to SEQ ID NO: 537173
  misc_feature: HIJSMM301C7BFR.27.23.C01.1.454.light.4.raw

SEQ ID NO: 562553 - DNA, 484 bp, Homo sapiens; identical to SEQ ID NO: 535211
  misc_feature: HIJSMM301A5SAD.47.46.E02.1.454.light.4.raw

SEQ ID NO: 562554 - DNA, 483 bp, Homo sapiens
  misc_feature: HIJSMM301AX951.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagatttgcagtctattactgtcagcagtatggtcacgtcccaagaactttggccagggaccaagctggagatcaaacgaactgtggctgcaccat

SEQ ID NO: 562555 - DNA, 508 bp, Homo sapiens
  misc_feature: HIJSMM301A24ZN.48.15.B04.1.454.light.4.raw
agtatacatacacgaccggtgctcgatttagacagtatatatccgcgggggctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaaactactcatttactcggcatccacccggaagtccgaggttcctgaccgattccgtggcagcgggtctgggacagattttactctcaccatcactaccctgcaggctgaagatgtggcagtttattactgtcaacaatattattctactccgccgacgttcggccgggggaccgaacgtggaaatcaaacgaactgtggctgcaccatctgtcttcatt

SEQ ID NO: 562556 - DNA, 495 bp, Homo sapiens
  misc_feature: HIJSMM301B4SCN.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcggccgtacgggaccgaccggtggagtgtcaagacgaacgtgtggctgcaccactcttcg

SEQ ID NO: 562557 - DNA, 483 bp, Homo sapiens
  misc_feature: HIJSMM301CSCGU.10.59.F04.1.454.light.4.raw
catagtagtgcacgaccggtgctcgatttagtacacacacttaggggattggggggggtcgtcaggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcaccatctcctgcactggaaccagcagtgatgttggtggttatgactttgtctcctggtaccaacagcagccaggcgaagcccccaaattcatgatttatgatgtcagtgcgcggccctcgggggtccctgatcgcttctctggctccaagtctggcaacacggcctccctgaccatctctggcctccagcctgaggatgaggctgattattactgttgctcatatgcaggcggtaccgcttgggtgttcggcggagggaccaagctgaccgtcctaggt

SEQ ID NO: 562558 - DNA, 475 bp, Homo sapiens
  misc_feature: HIJSMM301EL5S6.4.54.E10.1.454.light.4.raw
agcactgtagcacgaccggtgctcgatttagatcgtagcagaacacacaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcagcatcacttgccgggcaagtcagagcattagctacttttttaagttggtatcagcagacaccagggaaagcccctaagctcctgatctatgctgcttccagtttgcaaagtggggtcccatcaaggttcagtggcagtggatctgggacagatttcactctcactgtcagcagtctgcaatttgaagtattttgctaacttactactgtcaacagagtttcagttatcccttggactttcggccaagggaccaaggtggaatacaaacgaa

SEQ ID NO: 562559 - DNA, 499 bp, Homo sapiens
  misc_feature: HIJSMM301C97IV.15.1.A01.1.454.light.4.raw
  modified_base (496)..(496): a, c, t, g, unknown or other
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccacccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgcccctcggtnact

SEQ ID NO: 562560 - DNA, 485 bp, Homo sapiens; identical to SEQ ID NO: 539576
  misc_feature: HIJSMM301BDSVN.4.57.F02.1.454.light.4.raw

SEQ ID NO: 562561 - DNA, 504 bp, Homo sapiens
  misc_feature: HIJSMM301C97AN.48.36.D03.1.454.light.4.raw
agtatacatacacgaccggtgctcgatttagctgcgtcacgatctctcttgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgaccatctctgggctccaggctgaagatcaggctgattattactgctgttcattttcaagttcctttttgtcttcggaactgggaccgaggtcaccgtcctaggtcagcccaaggccaaccccactcgtcta

SEQ ID NO: 562562 - DNA, 512 bp, Homo sapiens
  misc_feature: HIJSMM301BZDHX.51.27.C05.1.454.light.4.raw
cgatcgtatacacgaccggtgctcgatttagacgcgatcgaagggtttggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctcctggtaccaacaccacccaggcaaagcccccaaactcatgatttatgatgtcagtgatcggccctcaggggtttcgaatcgcttctctggctccaagtccggcaacacggcctccctgaccatctctgggctccaggccgaggacgaggctgattattactgcacctcatatacaagcagcaacaattgggtgttcggcggagggaccaagctgaccgtcctaggtcagcccaaggctgccccctcggtcactctcg

SEQ ID NO: 562563 - DNA, 404 bp, Homo sapiens; identical to SEQ ID NO: 535779
  misc_feature: HIJSMM301EN4B8.4.35.D02.1.454.light.4.raw

SEQ ID NO: 562564 - DNA, 492 bp, Homo sapiens
  misc_feature: HIJSMM301CM8WQ.49.70.G04.1.454.light.4.raw
agtcgagagacacgaccggtgctcgatttagtgtagtgtgaagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctgaagattctgcagtttattactgtcagcagcgtagcaactggcctctcactttcggcggagggaccaaggtggagatcaaacgaactgtggctgcaccatctgtctt

SEQ ID NO: 562565 - DNA, 518 bp, Homo sapiens; identical to SEQ ID NO: 548899
  misc_feature: HIJSMM301AONQ3.41.25.C03.1.454.light.4.raw

SEQ ID NO: 562566 - DNA, 521 bp, Homo sapiens; identical to SEQ ID NO: 538715
  misc_feature: HIJSMM301A7VQ2.27.23.C01.1.454.light.4.raw

SEQ ID NO: 562567 - DNA, 500 bp, Homo sapiens; identical to SEQ ID NO: 536480
  misc_feature: HIJSMM301END0J.16.9.A09.1.454.light.4.raw

SEQ ID NO: 562568 - DNA, 488 bp, Homo sapiens
  misc_feature: HIJSMM301BXHFT.26.55.E11.1.454.light.4.raw
agactatactcacgaccggtgctcgatttagcactcgcacgttgggtttgggggcaggagtcagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggcaagtgagggcataaacaaattcttaaattggtatcaggagaaaccagggagagcccctaaggtcctgatctatggtgcatccattttgcaaagtggggtcccatcaaatttcagtggcagtggatctgggacagatttcactctcagcattaataatctgcaacctgaggattttgcaacttactactgtcaacagagttacaggcccccctatacttttggccaggggaccaagctggagatcacaggaactgtggctgcaccta

SEQ ID NO: 562569 - DNA, 486 bp, Homo sapiens; identical to SEQ ID NO: 561506
  misc_feature: HIJSMM301COG4R.4.57.F02.1.454.light.4.raw

SEQ ID NO: 562570 - DNA, 514 bp, Homo sapiens; identical to SEQ ID NO: 550705
  misc_feature: HIJSMM301BJRMP.43.23.C01.1.454.light.4.raw

SEQ ID NO: 562571 - DNA, 486 bp, Homo sapiens; identical to SEQ ID NO: 535385
  misc_feature: HIJSMM301DVQCX.19.71.G05.1.454.light.4.raw

SEQ ID NO: 562572 - DNA, 508 bp, Homo sapiens
  misc_feature: HIJSMM301ENYK9.3.79.H02.1.454.light.4.raw
agacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgattttttatatctctgtctcctggtaccaacaacacccaggcaaagcccccaaaactcatcatttatgatgtcactgctcggccctcaggggtttctcatcgcttttctggctccaagtctggcaccacggcctccctgaccatctcggggctccaggctgaggacgaggctgcttattactgcagctcatatacaaggagcaccactctcgtggtatttggtggagggaccaagctgaccgtcctaggtcagcccaaggctgccccctcggt

SEQ ID NO: 562573 - DNA, 504 bp, Homo sapiens
  misc_feature: HIJSMM301DZE63.48.36.D03.1.454.light.4.raw
agtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgaccatctctgggctccaggctgaagatcaggctgattattactgctgttcatttcaagttcctttttgtcttcggaactgggaccgaggtcaccgtcctaggtcagcccaaggccaaccccactcgtcta

SEQ ID NO: 562574 - DNA, 489 bp, Homo sapiens; identical to SEQ ID NO: 535139
  misc_feature: HIJSMM301AZE5W.14.55.E11.1.454.light.4.raw

SEQ ID NO: 562575 - DNA, 487 bp, Homo sapiens; identical to SEQ ID NO: 536206
  misc_feature: HIJSMM301CZXOR.47.38.D05.1.454.light.4.raw

SEQ ID NO: 562576 - DNA, 472 bp, Homo sapiens
  misc_feature: HIJSMM301AQK26.13.48.E04.1.454.light.4.raw
tcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtggggtcccatcaaggttcagcggcagtggatctggcacagacttcattctcaccatcagcagcctgcagcctgaagattttgcaacttattactgtctacaagatcacaattatcctgggacgttcggcaagggaccaaggtggaaatcaaacgaa

SEQ ID NO: 562577 - DNA, 489 bp, Homo sapiens; identical to SEQ ID NO: 542780
  misc_feature: HIJSMM301B1E6R.16.53.E09.1.454.light.4.raw

SEQ ID NO: 562578 - DNA, 485 bp, Homo sapiens; identical to SEQ ID NO: 542735
  misc_feature: HIJSMM301A7EB7.26.45.E01.1.454.light.4.raw

SEQ ID NO: 562579 - DNA, 487 bp, Homo sapiens
  misc_feature: HIJSMM301CYYV7.47.36.D03.1.454.light.4.raw
agctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacttgtcgggcgagtcagggtattagcaactggttagcctggtatcaacagaaaccagggaaagcccctaacctcctcatctctactgcatccactttgcaaagtgggtcccatcaaggttcagcggcagtggatctgggacagatttcactctcactatcagcagcctgcagcctgaagattttggaacttattattgtcaacagggtaacagtttcccgctcaccttcggcggagggaccaaggtggagatgaaaagactgtggctgcaccat

SEQ ID NO: 562580 - DNA, 463 bp, Homo sapiens
  misc_feature: HIJSMM301B3DXP.21.76.G10.1.454.light.4.raw
tcgtcgctcgcacgaccggtgctcgatttagtcactcatacagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtcaccatcacttgccgggcgggtcaggacattagacattatttagcctggtatcagcagaaaccaggtaaagttcccaagctcctgatctatgctgcatcctctttgcaatcagggtcccatctcggttcagtggcagtggatctgggacagatttcactctcaccatcagcagcctgcagcctgaagatgttgcaacttattactgtcaaaaatatagcagtgcccctctcactttcggcgcagggaccaaggtggacatcaaacg

SEQ ID NO: 562581 - DNA, 475 bp, Homo sapiens; identical to SEQ ID NO: 537714
  misc_feature: HIJSMM301DMAY7.7.81.H04.1.454.light.4.raw

SEQ ID NO: 562582 - DNA, 493 bp, Homo sapiens; identical to SEQ ID NO: 535084
  misc_feature: HIJSMM301B5W4Y.47.64.F09.1.454.light.4.raw

SEQ ID NO: 562583 - DNA, 484 bp, Homo sapiens; identical to SEQ ID NO: 535400
  misc_feature: HIJSMM301A2IMB.46.26.C04.1.454.light.4.raw

SEQ ID NO: 562584 - DNA, 521 bp, Homo sapiens; identical to SEQ ID NO: 539470
  misc_feature: HIJSMM301B2E9N.27.23.C01.1.454.light.4.raw

SEQ ID NO: 562585 - DNA, 494 bp, Homo sapiens
  misc_feature: HIJSMM301B6PED.15.59.F04.1.454.light.4.raw
  modified_base (476)..(476): a, c, t, g, unknown or other
tctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaaagctgccctcaccatcacgggggcccaggcagatgatgaatctgtttattattgtgtcctatatatgggtgctggcatttcggtcttcggcggagggaccaagctgaccgtcctaggtcagcccaaggctgccccctcggtcactctgttcccnccctcctcgctacgtaga

SEQ ID NO: 562586 - DNA, 494 bp, Homo sapiens; identical to SEQ ID NO: 539894
  misc_feature: HIJSMM301AE8HV.16.53.E09.1.454.light.4.raw

SEQ ID NO: 562587 - DNA, 496 bp, Homo sapiens; identical to SEQ ID NO: 552258
  misc_feature: HIJSMM301BIE6D.13.10.A10.1.454.light.4.raw

SEQ ID NO: 562588 - DNA, 494 bp, Homo sapiens; identical to SEQ ID NO: 536463
  misc_feature: HIJSMM301EG0CF.22.57.F02.1.454.light.4.raw

SEQ ID NO: 562589 - DNA, 484 bp, Homo sapiens; identical to SEQ ID NO: 535400
  misc_feature: HIJSMM301CD1IP.46.26.C04.1.454.light.4.raw

SEQ ID NO: 562590 - DNA, 511 bp, Homo sapiens
  misc_feature: HIJSMM301B8CWR.9.74.G08.1.454.light.4.raw
tgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagccaccctcggtgtcagtggccccaggaaagacggccaggataacctgtgagggaaataacattggaagtaaaagtgtgcactggtatcagcagaggccaggccaggcccctgtactggtcctctatgatgacagtggccggccctcagggatccctgagcgattctctggctccaagtctggcagcacggccaccctgaccatcagcagggtcgaagccggggatgaggccgactattactgtcaggtgtggagttttaatagtgatcatccgggggtattcggcggagggaccaaggtgaccgtcctacgtcagcccaaggctgccccctggtcactctgttcccgcctcct

SEQ ID NO: 562591 - DNA, 482 bp, Homo sapiens
  misc_feature: HIJSMM301D7GQA.49.83.H06.1.454.light.4.raw
agtcgagagacacgaccggtgctcgatttagatcacgtgcgtcgcggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagaatattaataagtggttggcctggtatcagcagataccagggaaagcccctaaactcctgatctatgaggcgtctagtttagaaagtggggtcccttcaaggttcagcggcagtggatctgggacagaattcactctcaccatcaacagcctgcagcctgatgattttgcaacttattactgccaacactataatcattattctccggccactttcggccctgggaccaggctagatatcggacgaactgtggctgcaccat

SEQ ID NO: 562592 - DNA, 483 bp, Homo sapiens
  misc_feature: HIJSMM301C7EGG.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtgggtcccatcaaggttcagtggcagtggatctgggacagatttcactctcaccatcaacagtctgcaacctgaagattttgcaacttactactgtcaacagagtttcactacccctctcactttcggcgggggaccgaaggtggagatcaaacgaactgtggctgcaccta

SEQ ID NO: 562593 - DNA, 486 bp, Homo sapiens; identical to SEQ ID NO: 551175
  misc_feature: HIJSMM301EJZOO.41.33.C11.1.454.light.4.raw

SEQ ID NO: 562594 - DNA, 473 bp, Homo sapiens
  misc_feature: HIJSMM301CCJ78.49.73.G07.1.454.light.4.raw
agtcgagagacacgaccggtgctcgatttagctctacgctcagggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcgtgtatctgaattggtatcagcaaaaaccagggaaagcccctgagctcctgatcctcgatgcatccaatttggaaacaggggtcccatcgaggttctctggaagtggctctgggacacattttacttcaccatcagcagactgcagcctgaagatattgcaacatattactgtcaacagtatgataatctcccgctcactttcggcgggaggaccgaaggtggagactacaacgaactagtggctg

SEQ ID NO: 562595 - DNA, 510 bp, Homo sapiens; identical to SEQ ID NO: 545115
  misc_feature: HIJSMM301BJR7Q.19.59.F04.1.454.light.4.raw

SEQ ID NO: 562596 - DNA, 510 bp, Homo sapiens; identical to SEQ ID NO: 535855
  misc_feature: HIJSMM301EAJN9.17.33.C11.1.454.light.4.raw

SEQ ID NO: 562597 - DNA, 472 bp, Homo sapiens
  misc_feature: HIJSMM301CTFZR.3.38.D05.1.454.light.4.raw
agacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactacccctctcactttcggcgggggaccaaggtggagatcaaacgaa

SEQ ID NO: 562598 - DNA, 487 bp, Homo sapiens; identical to SEQ ID NO: 536196
  misc_feature: HIJSMM301COL4K.11.28.C06.1.454.light.4.raw

SEQ ID NO: 562599 - DNA, 507 bp, Homo sapiens; identical to SEQ ID NO: 549725
  misc_feature: HIJSMM301DHQHD.18.78.H01.1.454.light.4.raw

SEQ ID NO: 562600 - DNA, 501 bp, Homo sapiens; identical to SEQ ID NO: 542394
  misc_feature: HIJSMM301DB4XB.18.23.C01.1.454.light.4.raw

SEQ ID NO: 562601 - DNA, 485 bp, Homo sapiens; identical to SEQ ID NO: 535606
  misc_feature: HIJSMM301AEC2I.47.46.E02.1.454.light.4.raw

SEQ ID NO: 562602 - DNA, 497 bp, Homo sapiens
  misc_feature: HIJSMM301DDGYJ.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccgaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggcggagggaccgagggtggagatcaaacgaactgtggctgcaccatctgtcttcattcc

SEQ ID NO: 562603 - DNA, 448 bp, Homo sapiens
  misc_feature: HIJSMM301AOJDR.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctcggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccgccctcctccatactcgta

SEQ ID NO: 562604 - DNA, 473 bp, Homo sapiens
  misc_feature: HIJSMM301C9U1P.11.17.B06.1.454.light.4.raw
cgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccgggcaagtcagatcattagcagctatttaaattggtatcagcagaaaccagggaaagcccctgaggtcctgatctatgctgcatccagtttgcagagtggggtcccatcaaggttcagtggcagtggatctgcgacagatttcactctcaccatcagcagtctgcaacctgaagattttgcaacttactactgtcaatagagttacagtaccccgtggacgttcggccaagggaccaaggtggaaatcaaacgaactagtgg

SEQ ID NO: 562605 - DNA, 520 bp, Homo sapiens
  misc_feature: HIJSMM301D1L2D.27.23.C01.1.454.light.4.raw
  modified_base (517)..(517): a, c, t, g, unknown or other
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccncct

SEQ ID NO: 562606 - DNA, 495 bp, Homo sapiens; identical to SEQ ID NO: 535821
  misc_feature: HIJSMM301BOZKG.3.31.C09.1.454.light.4.raw

SEQ ID NO: 562607 - DNA, 509 bp, Homo sapiens; identical to SEQ ID NO: 559299
  misc_feature: HIJSMM301AHE2B.17.28.C06.1.454.light.4.raw

SEQ ID NO: 562608 - DNA, 499 bp, Homo sapiens
  misc_feature: HIJSMM301C0MGN.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatattttcgtgctccgtacacttttggccaggggacccaggtggagatcagacgaactgtggttgcaccatctgtcttcatcttcccgccta

SEQ ID NO: 562609 - DNA, 499 bp, Homo sapiens; identical to SEQ ID NO: 536187
  misc_feature: HIJSMM301D2S6L.11.67.G01.1.454.light.4.raw

SEQ ID NO: 562610 - DNA, 474 bp, Homo sapiens; identical to SEQ ID NO: 541431
  misc_feature: HIJSMM301BVUI4.4.14.B03.1.454.light.4.raw

SEQ ID NO: 562611 - DNA, 487 bp, Homo sapiens
  misc_feature: HIJSMM301DPKH9.51.6.A06.1.454.light.4.raw
cgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgattctctggctccacctcagggacaatggtcacattgaccatcagtggagtccaggcagaagacgaggctgactatttctgtcaatcttcagacatcagtggtacttatgtcttcggaactgggaccaaggtcaccgtctaggtcagcccaaggccaacccactgtcact

SEQ ID NO: 562612 - DNA, 497 bp, Homo sapiens; identical to SEQ ID NO: 536807
  misc_feature: HIJSMM301B5ASY.10.37.D04.1.454.light.4.raw

SEQ ID NO: 562613 - DNA, 502 bp, Homo sapiens; identical to SEQ ID NO: 541971
  misc_feature: HIJSMM301BOQCG.4.39.D06.1.454.light.4.raw

SEQ ID NO: 562614 - DNA, 489 bp, Homo sapiens; identical to SEQ ID NO: 535091
  misc_feature: HIJSMM301D4BF6.47.36.D03.1.454.light.4.raw

SEQ ID NO: 562615 - DNA, 497 bp, Homo sapiens; identical to SEQ ID NO: 535286
  misc_feature: HIJSMM301DE6LQ.18.59.F04.1.454.light.4.raw

SEQ ID NO: 562616 - DNA, 508 bp, Homo sapiens
  misc_feature: HIJSMM301EASS4.10.55.E11.1.454.light.4.raw
catagtagtgcacgaccggtgctcgatttagcactcgcacgttgggtttgggggagctgctcagttaggacccagagggaaccatggaaagcccagcgcagcttctcttcctcctgctactctggctcccagagacgaccggagagattgtattgacgcagtctccaaccaccctgtctttgtctccgtggggggagagccaccctctcctgcagggccagtgaaccttttagtagtagttatttagcctggtatcggcaaaaacctggccaggctccccgactcctcttctttggtggagcctacagggccactggccaccccagacaggatcagtggcagcgggtctgggacagacttcattctcaccatcaacagactgcagcctgaagatattgcagtttactactgtcagcagtatgttacgtccccgtggacgttcggccaaggaccaaggtggcaatcaaccgaactgtggctgcaccatctgtcttcatcttcccgccat

SEQ ID NO: 562617 - DNA, 485 bp, Homo sapiens; identical to SEQ ID NO: 536075
  misc_feature: HIJSMM301EM0YL.17.21.B10.1.454.light.4.raw

SEQ ID NO: 562618 - DNA, 493 bp, Homo sapiens; identical to SEQ ID NO: 536289
  misc_feature: HIJSMM301CQJPK.14.5.A05.1.454.light.4.raw

SEQ ID NO: 562619 - DNA, 492 bp, Homo sapiens
  misc_feature: HIJSMM301BENRG.15.74.G08.1.454.light.4.raw
tctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtgggagatagagtcaccatcacttgccgggccagtcagagtattagtacctggttggcctggtatcagcagaaaccagggaaagcccctaaactcctgatgtataaggcatctagcttagaaagtggggtgccatcaaggttcagcggcagtggatctgggacagaattcactctcaccatcagcaccctgcagcctgatgattttgcaacttattactgtcaacagtataatagtaattcctggacgttcggccaagggaccgaaggtaggaaatacaaacgaactagtggctgcaccatctgtctt

SEQ ID NO: 562620 - DNA, 492 bp, Homo sapiens; identical to SEQ ID NO: 543155
  misc_feature: HIJSMM301EKQN6.10.53.E09.1.454.light.4.raw

SEQ ID NO: 562621 - DNA, 512 bp, Homo sapiens
  misc_feature: HIJSMM301BJYF0.7.34.D01.1.454.light.4.raw
cgtgtctctacacgaccggtgctcgatttagatcgtctgtgttgggtttggggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggactccagactgaggacgaggctgattattactgctgctcatatacaggggacagcattatttgggtgttcggcggagggaccaagctgaccgtcctgcgtcagcccaaggctgccccctcggtcactc

SEQ ID NO: 562622 - DNA, 517 bp, Homo sapiens
  misc_feature: HIJSMM301BNY6Z.15.57.F02.1.454.light.4.raw
tctacgtagccacgaccggtgctcgatttagctcgatatagttggggtttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcactcatttatgaagtctctaagcggccctcagggtatctaatcgcttctctggctccaagtctggcaacacggcctccctgaccgtctctggcctccagactcgaggacgaggctgattattactgccactcatatagaagtagtactactcctgtggttttcggcggagggaccaagctgaccgtcctaggtcagcccaaggctcgcccctcggtcactctcg

SEQ ID NO: 562623 - DNA, 514 bp, Homo sapiens
  misc_feature: HIJSMM301B2T1V.22.36.D03.1.454.light.4.raw
acatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaacccccccaactcatcatttatggtgtcactcgtcggccctcaggagtctctcatcgcttctcaggctccaagtctggcacacggcctccctaaccatctctgggctccagtttgaggacgagtctacttattactgcagttcctttaaattaggcgccactctcgtggttttcggcggaggcaccgaagtgaccgtcctcggtcagcccaacggctgccccctccggtcact

SEQ ID NO: 562624 - DNA, 502 bp, Homo sapiens; identical to SEQ ID NO: 541971
  misc_feature: HIJSMM301BGKIC.4.39.D06.1.454.light.4.raw

SEQ ID NO: 562625 - DNA, 490 bp, Homo sapiens
  misc_feature: HIJSMM301B9FEV.47.60.F05.1.454.light.4.raw
agctcacgtacacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactcggtttcccagccaggttcagtggcagtgcgtctgcgacagagttcactctcaccatcaacagcctgcagtctgaagtattttgctagtttattactgtcagcagtatcatgactggccgctccaccttcggccaagggacacgactggagtaattaaacgaactgtggctgcaccat

SEQ ID NO: 562626 - DNA, 491 bp, Homo sapiens; identical to SEQ ID NO: 543478
  misc_feature: HIJSMM301AJNUU.14.55.E11.1.454.light.4.raw

SEQ ID NO: 562627 - DNA, 520 bp, Homo sapiens
  misc_feature: HIJSMM301AKJNU.41.19.B08.1.454.light.4.raw
tctatactatcacgaccggtgctcgatttagtgagtcagtaagggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggcccaacccactgtcactctgttcccaccctcct

SEQ ID NO: 562628 - DNA, 496 bp, Homo sapiens; identical to SEQ ID NO: 537925
  misc_feature: HIJSMM301BPLWC.22.14.B03.1.454.light.4.raw

SEQ ID NO: 562629 - DNA, 485 bp, Homo sapiens; identical to SEQ ID NO: 538824
  misc_feature: HIJSMM301C0W20.48.57.F02.1.454.light.4.raw

SEQ ID NO: 562630 - DNA, 454 bp, Homo sapiens
  misc_feature: HIJSMM301AKHK1.18.78.H01.1.454.light.4.raw
tacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccactgtcactttgttcccaccctcctccatactcgta

SEQ ID NO: 562631 - DNA, 441 bp, Homo sapiens; identical to SEQ ID NO: 534971
  misc_feature: HIJSMM301DQE22.11.3.A03.1.454.light.4.raw

SEQ ID NO: 562632 - DNA, 505 bp, Homo sapiens
  misc_feature: HIJSMM301A4D0S.14.3.A03.1.454.light.4.raw
cgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctggtaccaacagcacccaggcaaagcccccaaactcattatttatgaggtcaataatcggccctcaggagtttctaatcgcttctctggctccaagtctggcaacacggcctccctgagcatctctgggctccaggctgaggacgaggctgattattactgcagctcatatactattagcagaactgtggttttcggcggagggccaaggtgaccgtcctaggtcagcccaaggctgccccctcggtcactcttcg

SEQ ID NO: 562633 - DNA, 505 bp, Homo sapiens; identical to SEQ ID NO: 536254
  misc_feature: HIJSMM301DTXQC.7.71.G05.1.454.light.4.raw

SEQ ID NO: 562634 - DNA, 511 bp, Homo sapiens
  misc_feature: HIJSMM301CZ1UB.12.21.B10.1.454.light.4.raw
atacgacgtacacgaccggtgctcgatttagtgtcgtcgcaagagaggaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatacaagcagcagcacctctttgtcttcggaagtggaccaaggtcaccgtccacgtcagcccaaggccaacccactgtcactctcg

SEQ ID NO: 562635 - DNA, 494 bp, Homo sapiens; identical to SEQ ID NO: 534994
  misc_feature: HIJSMM301BPMZ3.27.78.H01.1.454.light.4.raw

SEQ ID NO: 562636 - DNA, 497 bp, Homo sapiens
  misc_feature: HIJSMM301AWRU9.11.59.F04.1.454.light.4.raw
cgagagataccacgaccggtgctcgatttagtacacacacttagggattggggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctactcttttctcttcggaactgggaccacggtcaccgtcctaggtcagcccaaggccaaccccactgtcactcctgttcccaccctcctcgtatct

SEQ ID NO: 562637 - DNA, 485 bp, Homo sapiens; identical to SEQ ID NO: 536040
  misc_feature: HIJSMM301C6M4G.15.1.A01.1.454.light.4.raw

SEQ ID NO: 562638 - DNA, 505 bp, Homo sapiens
  misc_feature: HIJSMM301CXOOB.11.67.G01.1.454.light.4.raw
cgagagataccacgaccggtgctcgatttagagtatacatattgggtttggggggttgagaagacaggactcaggacaatctccagcatggccagcttccctctcctcctcaccctcctcactcactgtgcagggtcctgggcccagtctgttctgactcagccaccctcagcgtctgggacccccgggcagagaatcaccatctcttgtactggaagcagctccaatatcggaagtaacgatgtcaattggtatcaacatctccccggtacggcccccaaactcctcatctataggaatagccagcggccctcaggggtccctggccgattctctggctcgaagtctggcacctcagcctcctggcctgcagtgggctccagtctgaggatgaggctgactattattgtgcagcgtgggatgacggtctgagtgctgtggtcttcggcggagggaccaagctgaccgtcctgggtcagcccaaggctgccccctcggtcactcg

SEQ ID NO: 562639 - DNA, 492 bp, Homo sapiens; identical to SEQ ID NO: 536010
  misc_feature: HIJSMM301A8QTF.10.20.B09.1.454.light.4.raw

SEQ ID NO: 562640 - DNA, 522 bp, Homo sapiens
  misc_feature: HIJSMM301CZBZU.9.38.D05.1.454.light.4.raw
tgatacgtctcacgaccggtgctcgatttagtatctgatagttgggtttgggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaatacccggcaaagcccccaaactcttgctttatgatgtcagttatcggccctcaggagtttctgatcgcttctctggctccaagtctggcaccacggcctccctgaccatctctgggctccaggctgaggacgaggctgattatttctgcagctcaaaagaagtagcctctcgtggttttcggcgggggaccgaaggtgaccgtcctaagtcagcccaaggctgccccctcggtcactctgttcccaccctcctctacg

SEQ ID NO: 562641 - DNA, 495 bp, Homo sapiens; identical to SEQ ID NO: 544109
  misc_feature: HIJSMM301A8DPN.22.86.H09.1.454.light.4.raw

SEQ ID NO: 562642 - DNA, 496 bp, Homo sapiens; identical to SEQ ID NO: 535541
  misc_feature: HIJSMM301DDBEO.3.33.C11.1.454.light.4.raw

SEQ ID NO: 562643 - DNA, 511 bp, Homo sapiens
  misc_feature: HIJSMM301ECWRW.52.41.D08.1.454.light.4.raw
cgcagtacgacacgaccggtgctcgatttagtcacgcgagaaagggaaagggggcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccggtcagagggtcaccatctcttgttctggaggcggctccaacatcggagggaatactgtgaactggtaccagcaactcccagggacggcccccagactcctcatctttagtcataatcagcggccctcaggggtccctgaccgattctctggctccaagtctggcacctcagcctccttggccatcagtgggctccagtctgacgatgaggctgattacttctgtgcaacttgggatgacagcctgaatggtccggtgttcggcggagggaccaagcttaccgtctgggtcagcccaaggctgccccctcggt

SEQ ID NO: 562644 - DNA, 490 bp, Homo sapiens
  misc_feature: HIJSMM301B7AY5.48.1.A01.1.454.light.4.raw
agtatacatacacgaccggtgctcgatttagacgtctcatcagggggcaggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaattttcgctgtctccagtttgcagagtggagtcccatctcggttcagcggcagtggatctggggcagagttcattctcaccatcaacagccttcagcctgaagattttgcaacttactattgtcagcagggtgacagtttccctccactttcggcggagggaccagggtggacgtcaaacgaactgtggctgcaccatctgtcttcat

SEQ ID NO: 562645 - DNA, 510 bp, Homo sapiens
  misc_feature: HIJSMM301APUP6.9.55.E11.1.454.light.4.raw
tgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtgaaagaaacatcattggaggtgttagtgtacactggtaccagcagaagccaggccaggcccctgtgctggtcctccatcatactagcgaccggccctcagggatccctgagcgattctcaggctccaactctgggaaaacggccaccctgaccatcagcagggtcgaagccggggatgaggccgactattactgtcaggtgtgggctggtgataatgatcatggcgggggtgttcggcggagggaccaagctgaccgtcctaagtcagcccaaggctcgccccctcggtcactctcg

SEQ ID NO: 562646 - DNA, 494 bp, Homo sapiens; identical to SEQ ID NO: 534992
  misc_feature: HIJSMM301EJV4B.9.1.A01.1.454.light.4.raw

SEQ ID NO: 562647 - DNA, 484 bp, Homo sapiens; identical to SEQ ID NO: 535400
  misc_feature: HIJSMM301A2FRF.46.26.C04.1.454.light.4.raw

SEQ ID NO: 562648 - DNA, 498 bp, Homo sapiens
  misc_feature: HIJSMM301EJZ4M.10.79.H02.1.454.light.4.raw
catagtagtgcacgaccggtgctcgatttagtgtcacacgaagggaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggtccaggggaccgaagctggagatcaaacgaactagtggctgcaccatctgtctt

SEQ ID NO: 562649 - DNA, 505 bp, Homo sapiens
  misc_feature: HIJSMM301DT55B.48.78.H01.1.454.light.4.raw
  modified_base (375)..(375): a, c, t, g, unknown or other
agtatacatacacgaccggtgctcgatttagtgtgagtagtttgggtttggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaagcctggccaggctcccagactcctcatctatgatgcgtctaccagggccactggcgtcccggccaggttcagtgccagtgggtctgggacagacttcactctcaccatcggggancagcctagagcccgaagattttgcggtttattactgtcagcagcgtgccaactggcctctcacgttcggcggagggaccaaggtggacatcaaacgaactgtggctgcaccatctgtcttcatcttcccg

SEQ ID NO: 562650 - DNA, 494 bp, Homo sapiens
  misc_feature: HIJSMM301D463L.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccctcggtcactctgttcccaccctcctcgagtgcgt

SEQ ID NO: 562651 - DNA, 500 bp, Homo sapiens
  misc_feature: HIJSMM301A1RLA.17.29.C07.1.454.light.4.raw
cgtagactagcacgaccggtgctcgatttagagtgctacgaagggaaaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcggcggtgggaccaagctgaccgtcctaggtcagcccaaggctgccccccg

SEQ ID NO: 562652 - DNA, 518 bp, Homo sapiens
  misc_feature: HIJSMM301BWCJI.9.38.D05.1.454.light.4.raw
tgatacgtctcacgaccggtgctcgatttagtatctgatagttgagtttgggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaataccccggcaaagcccccaaactcttgctttatgatgtcagttatcggccctcaggagtttctgatcgcttctctggctccaagtctggcaccacggcctccctgaccatctctgggctccaggctgaggacgaggctgattatttctgcagctcaaaaagaagtagccctctcgtggttttcggcgggggaccaaggtgaccgtcctaagtcagcccaaggctgccccctcggtcactctcgttcccaccctcct

SEQ ID NO: 562653 - DNA, 504 bp, Homo sapiens
  misc_feature: HIJSMM301BS801.12.48.E04.1.454.light.4.raw
atacgacgtacacgaccggtgctcgatttagagagcgtcacagagagaaggggagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatttcttgttctggaacccactccaacatcggatataattctgtagactggtaccagcagcttccaggagcggcccccgactcctcatcttaataacaatcagcggccctcaggggtccctgaccgattctctggctccaagtctggcacctcagcctccctggccatcagtgggctccagtctgaggatgaggctgattattactgtgcatcatgggctgacaccctgactggtccgggagtgttcggcggagggaccaagctgaccgtcctaggtcagcccaaggccagccccctcggtcactc

SEQ ID NO: 562654 - DNA, 485 bp, Homo sapiens
  misc_feature: HIJSMM301BRV6Z.43.72.G06.1.454.light.4.raw
tgtgagtagtcacgaccggtgctcgatttagctacgactgcaagggaaaggggagagctctggagaagagctgctcagttaggacccagagggaaccatggaaaccccagcgcagcttctcttcctcctgctactctggctcccagatgccaccggagcaattgtgttgacgcagtctccaggcaccctgtctttgtctccaggagaaacagccaccctctcctgccgggccagtcagagtgttagagaagactacttagcctggtaccagcaaaaacctggccaggctcccaggctcctcatcaatggtgcatccagtagggccactggcatcccagacaggttcagtggcagtgggtctgcgacagacttcactctcattatcagcagactggagcctgaggactttgcagtgtatttctgtcaacaatatggtagctcaccgtacacttttggccaggggaccaagctagaaatcaaacgaa

SEQ ID NO: 562655 - DNA, 494 bp, Homo sapiens; identical to SEQ ID NO: 534992
  misc_feature: HIJSMM301D4D7J.9.1.A01.1.454.light.4.raw

SEQ ID NO: 562656 - DNA, 492 bp, Homo sapiens
  misc_feature: HIJSMM301EIOR6.17.25.C03.1.454.light.4.raw
cgtagactagcacgaccggtgctcgatttagtagtgtagatttgggtttgggggagtcagtctcagtcaggacacagcatggacatgagggtccccgctcagctcctggggctcctgactactctggctccgagctgccagatgtgacatccagatgacccagtctccatcctcctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacagatttcaatctcaccatcaccactctgcaacctgaggattgtgcaatctactactgtcaacagagttacagttccccctcgccacttttggccaggggaccgaaagttgagatcaaacgaactgtggctgcaccatctgtt

SEQ ID NO: 562657 - DNA, 502 bp, Homo sapiens
  misc_feature: HIJSMM301CLXB0.40.57.F02.1.454.light.4.raw
tctagcgactcacgaccggtgctcgatttagctcgatatagttgggtttgggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcccccatgtggtattcggcggagggaccaagctgaccgtcctaggtcagcccaaggctcg

SEQ ID NO: 562658 - DNA, 484 bp, Homo sapiens; identical to SEQ ID NO: 536162
  misc_feature: HIJSMM301ASM3D.13.59.F04.1.454.light.4.raw

SEQ ID NO: 562659 - DNA, 489 bp, Homo sapiens
  misc_feature: HIJSMM301CRZH9.19.57.F02.1.454.light.4.raw
tactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgctaacttatttttgtcaacaggctaacactttccccctcactttcggcggagggaccaaggtggagatcaagcgaactgtggctgcaccat

SEQ ID NO: 562660 - DNA, 472 bp, Homo sapiens; identical to SEQ ID NO: 536302
  misc_feature: HIJSMM301E1A3E.18.76.G10.1.454.light.4.raw

SEQ ID NO: 562661 - DNA, 493 bp, Homo sapiens; identical to SEQ ID NO: 536769
  misc_feature: HIJSMM301CVXV5.19.83.H06.1.454.light.4.raw

SEQ ID NO: 562662 - DNA, 506 bp, Homo sapiens; identical to SEQ ID NO: 535058
  misc_feature: HIJSMM301EPPU0.17.41.D08.1.454.light.4.raw

SEQ ID NO: 562663 - DNA, 495 bp, Homo sapiens; identical to SEQ ID NO: 535007
  misc_feature: HIJSMM301CP3P5.22.5.A05.1.454.light.4.raw

SEQ ID NO: 562664 - DNA, 475 bp, Homo sapiens; identical to SEQ ID NO: 551151
  misc_feature: HIJSMM301DI8R8.13.76.G10.1.454.light.4.raw

SEQ ID NO: 562665 - DNA, 507 bp, Homo sapiens
  misc_feature: HIJSMM301EZMZ8.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacgaggggtcccatcaaggttcagtggaggtggatctgggacagtattttactctcggcatccgcagcctgcagcctgaagtattttgcgacatattactgtacaacagtatagaaaatgtcccgctctactttcgggcgggggaccgaaggtggagttacaaacgaactgtggctgcaccatctgtcttctattccc

SEQ ID NO: 562666 - DNA, 482 bp, Homo sapiens; identical to SEQ ID NO: 539800
  misc_feature: HIJSMM301A37F0.21.25.C03.1.454.light.4.raw

SEQ ID NO: 562667 - DNA, 502 bp, Homo sapiens; identical to SEQ ID NO: 536253
  misc_feature: HIJSMM301A4FLL.21.22.B11.1.454.light.4.raw

SEQ ID NO: 562668 - DNA, 486 bp, Homo sapiens; identical to SEQ ID NO: 537617
  misc_feature: HIJSMM301AHG29.10.53.E09.1.454.light.4.raw

SEQ ID NO: 562669 - DNA, 494 bp, Homo sapiens; identical to SEQ ID NO: 539065
  misc_feature: HIJSMM301C03IW.11.81.H04.1.454.light.4.raw

SEQ ID NO: 562670 - DNA, 499 bp, Homo sapiens
  misc_feature: HIJSMM301EO00W.48.33.C11.1.454.light.4.raw
agtatacatacacgaccggtgctcgatttagagtgagctcgttgggtttggggggctcaggaggcagagctctgggaatctcaccatggcctggacccctctcctgctcccctcctcactttctgcacagtctctgaggcctcctatgagctgacacagccaccctcggtgtcagtgtccccaggacaaacggccaggatcacctgctctggagatgcattgaccaaaaaaatatgcttattggtaccagcagaagtcaggccaggcccctgtgctggtcatctttgaggacaacaaacgaccctcgggatccctgagagattctctggctccagctcagggacaatggccaccttgactatcaatggggcccaggtggacgatgaggctgactactactgttcctcaacagacagtagtggtgatcgagggctgttcggcggagggaccaagctgaccgtctaagtcagcccaaggctgccccctcggtcactctgtt

SEQ ID NO: 562671 - DNA, 489 bp, Homo sapiens; identical to SEQ ID NO: 550920
  misc_feature: HIJSMM301CI59V.41.23.C01.1.454.light.4.raw

SEQ ID NO: 562672 - DNA, 513 bp, Homo sapiens
  misc_feature: HIJSMM301BVMEP.40.12.B01.1.454.light.4.raw
tctagcgactcacgaccggtgctcgatttagtagtgtagattccgcgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaactacacccaggcaaagcccccaaactcatgatttctgacgtcagtaagcggccctcaggggtccctgatcgcttctctggctccaagtctggcaacacggcctccctgaccgtctctgggctccaggctgaagatgaggctgattattactgctactcgtatgcaggcggcaacaattgggtcttcggcggagggaccaagctgaccgtcctaggtcagcccaaggctgccccctcggtcactctgttcccg

SEQ ID NO: 562673 - DNA, 498 bp, Homo sapiens; identical to SEQ ID NO: 537020
  misc_feature: HIJSMM301AUL8H.26.26.C04.1.454.light.4.raw

SEQ ID NO: 562674 - DNA, 490 bp, Homo sapiens; identical to SEQ ID NO: 535936
  misc_feature: HIJSMM301BTMA5.16.68.G02.1.454.light.4.raw

SEQ ID NO: 562675 - DNA, 502 bp, Homo sapiens
  misc_feature: HIJSMM301C3UBG.16.9.A09.1.454.light.4.raw
tgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagcttccctcagtgtccgtgtccccgggacagacagccagcatcacctgctctggagataacctgggaagtaaatttactttctggtatcagcggaagccaggccagtcccctgttttggtcatctataaagataggaatcggccctcagacatccctgagcgattctctggctccagctctggaaacacagccactctgaccatcaccgggacccagactatggatgaagctgactattactgtcaggcgtgggacagcggcactgtggttttcggcggagggaccaagctgaccgtcctcggtcagcccaaggctgccccctcggtcactctcgttcccaccct

SEQ ID NO: 562676 - DNA, 447 bp, Homo sapiens; identical to SEQ ID NO: 535201
  misc_feature: HIJSMM301A2YQ7.18.9.A09.1.454.light.4.raw

SEQ ID NO: 562677 - DNA, 519 bp, Homo sapiens
  misc_feature: HIJSMM301EKE1Z.13.87.H10.1.454.light.4.raw
tcacgtactacacgaccggtgctcgatttagcagtactgcgttgggtttggggagtcccagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcggtccaacgggaccgaacggtaggaaagtacaagacgaactacgtggcgtgcgaccactctgtcttcacttcttcccgtccctact

SEQ ID NO: 562678 - DNA, 497 bp, Homo sapiens
  misc_feature: HIJSMM301DPMYH.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccaggggaccaagctggagatcaaaacgaactgtggctgcaccatctgt

SEQ ID NO: 562679 - DNA, 517 bp, Homo sapiens
  misc_feature: HIJSMM301AJ5ZY.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgccacggaccgaacggtaggaaggtacgaaacgaactagtaggcgtgcgaccactctgtcttctactcttcccgtcccact

SEQ ID NO: 562680 - DNA, 491 bp, Homo sapiens; identical to SEQ ID NO: 543766
  misc_feature: HIJSMM301AN3D9.11.81.H04.1.454.light.4.raw

SEQ ID NO: 562681 - DNA, 509 bp, Homo sapiens; identical to SEQ ID NO: 543741
  misc_feature: HIJSMM301DPMZT.17.33.C11.1.454.light.4.raw

SEQ ID NO: 562682 - DNA, 513 bp, Homo sapiens
  misc_feature: HIJSMM301ERLSC.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaactcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcggtccaacggaccgaaggtacggaaagtacaagacgaactagtggcgtgcaccaactctgtcttcactcttcccgt

SEQ ID NO: 562683 - DNA, 491 bp, Homo sapiens
  misc_feature: HIJSMM301ATAB8.51.71.G05.1.454.light.4.raw
cgatcgtatacacgaccggtgctcgatttagtgtcgtcgcaagagagagggggggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcact

SEQ ID NO: 562684 - DNA, 494 bp, Homo sapiens; identical to SEQ ID NO: 554249
  misc_feature: HIJSMM301BN1G8.10.33.C11.1.454.light.4.raw

SEQ ID NO: 562685 - DNA, 505 bp, Homo sapiens
  misc_feature: HIJSMM301D6JSJ.12.48.E04.1.454.light.4.raw
atacgacgtacacgaccggtgctcgatttagagagcgtcacagagagaaggggagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatttcttgttctggaacccactccaacatcggatataattctgtagactggtaccagcagcttccaggagcggccccccgactcctcatctttaataacaatcagcggccctcaggggtccctgaccgattctctggctccaagtctggcacctcagcctccctggccatcagtgggctccagtctgaggatgaggctgattattactgtgcatcatgggctgacaccctgactggtccgggagtgttcggcggagggaccaagctgaccgtctaggtcagcccaaggcagcccccc

SEQ ID NO: 562686 - DNA, 496 bp, Homo sapiens; identical to SEQ ID NO: 538376
  misc_feature: HIJSMM301EGJE5.51.23.C01.1.454.light.4.raw

SEQ ID NO: 562687 - DNA, 494 bp, Homo sapiens
  misc_feature: HIJSMM301BAJAZ.15.71.G05.1.454.light.4.raw
tctacgtagccacgaccggtgctcgatttagtgtcgtcgcaagagagagggggtcaggctggaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcagaaaccagggaaagcccctaagctcctgatctatggtgcatccagtttggaaagtggggtcccaccaaggttcagcggcagtgaatctgggacagatttcactctcaccatcagcagcctgcagcctgaggattttgcaacttactattgtcaacaggctaacagtttccctctcactttcggcggagggaccaaggtggatatcaaacgaactgtggctgcacca

SEQ ID NO: 562688 - DNA, 489 bp, Homo sapiens
  misc_feature: HIJSMM301BRCCV.43.33.C11.1.454.light.4.raw
tgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctcccccctacaactttcggtcaggggaccaagttgaacatcaatcgaactgtggctgcaccat

SEQ ID NO: 562689 - DNA, 489 bp, Homo sapiens
  misc_feature: HIJSMM301CIBCF.16.73.G07.1.454.light.4.raw
tgtactactccacgaccggtgctcgatttagctctacgctcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcaacaatattataataatccatttaatttcggcggagggaccaaggtggagatcaaacgaactgtgctgcaccatctgtcttcatcttcccgcc

SEQ ID NO: 562690 - DNA, 496 bp, Homo sapiens
  misc_feature: HIJSMM301AYHPX.51.5.A05.1.454.light.4.raw
cgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaagaaatctgctttttggtaccatcagaggccaggccaggcccctgtattggtcatctatgaggacaccaagcgaccctccggaatccctgagagagtcgctggctccaggtcagggacaatggccaccttgactatcactgggacccagatggacgatgaaggtgactaccactgttattcgacagacagcagtggtagtcagggggtcttcggcggagggacgaagctgaccgtcctgagtcagccaaggctgccccctcggtcactctgtt

SEQ ID NO: 562691 - DNA, 504 bp, Homo sapiens
  misc_feature: HIJSMM301CFW25.19.78.H01.1.454.light.4.raw
tactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctcctgacaatctctgggctccaggctgaggacgaggctgattactactgctgctcatatgcaggtcgtatctcttatgtcttcggaactgggaccaaggtcaccgtcctaggtcagcccaaggccaaccccactgtca

SEQ ID NO: 562692 - DNA, 495 bp, Homo sapiens
  misc_feature: HIJSMM301AD43Y.16.72.G06.1.454.light.4.raw
  modified_base (199)..(199): a, c, t, g, unknown or other
tgtactactccacgaccggtgctcgatttagctacgactgcaagggaaagggggaggaactgctcagttaggacccagacggaaccatggaagccccagcgcagcttcacttcctcctgctactctggctcccagatacctctggagaaacagtgatgacgcagtctccagccaccctctctgtgtctccaggggaaanagtcaccctctcctgcagggccagtcagagtgttagcagcaacttagcctggtatcagcagaaacctggccaggctcccaggctcctcatctatgatgcatccaccagggccactggtatcccagccaggttcagtggcagtgggtttgggacagagttcactctcaccatcagcagcctgcagtctgaagattttgcagtttattactgtcagcagtataataactggcctccggtcactttcggtcggagggaccgaacggtggagatcaaacgaactagtggcgtcgcaccat

SEQ ID NO: 562693 - DNA, 486 bp, Homo sapiens; identical to SEQ ID NO: 535523
  misc_feature: HIJSMM301D5XXM.22.73.G07.1.454.light.4.raw

SEQ ID NO: 562694 - DNA, 473 bp, Homo sapiens
  misc_feature: HIJSMM301EY45E.13.48.E04.1.454.light.4.raw
tcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtggggtcccatcaaggttcagcggcagtggatctgacacagacttcattctcaccatcagcagcctgcagcctgaagattttgcaacttatactgtctacaagatcacaattatcctgggacgttcggccaagggaccaaggtggaaatacaaacgaa

SEQ ID NO: 562695 - DNA, 491 bp, Homo sapiens
  misc_feature: HIJSMM301DUBLN.48.53.E09.1.454.light.4.raw
agtatacatacacgaccggtgctcgatttagagagagtgtgttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctgccccccg

SEQ ID NO: 562696 - DNA, 479 bp, Homo sapiens
  misc_feature: HIJSMM301D2SMR.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggacttcgccgaaggaccgaaggtaggaatacaacgaactagtggctgc

SEQ ID NO: 562697 - DNA, 493 bp, Homo sapiens; identical to SEQ ID NO: 535084
  misc_feature: HIJSMM301DKTL5.47.64.F09.1.454.light.4.raw

SEQ ID NO: 562698 - DNA, 494 bp, Homo sapiens
  misc_feature: HIJSMM301AQRLR.52.38.D05.1.454.light.4.raw
cgcagtacgacacgaccggtgctcgatttagtatctgatagttgggttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctggtcagcccaaggccaaccccactgtcact

SEQ ID NO: 562699 - DNA, 485 bp, Homo sapiens; identical to SEQ ID NO: 535606
  misc_feature: HIJSMM301CNKPY.47.46.E02.1.454.light.4.raw

SEQ ID NO: 562700 - DNA, 494 bp, Homo sapiens; identical to SEQ ID NO: 534992
  misc_feature: HIJSMM301EMZ9Q.9.1.A01.1.454.light.4.raw

SEQ ID NO: 562701 - DNA, 494 bp, Homo sapiens; identical to SEQ ID NO: 534992
  misc_feature: HIJSMM301DZ3TP.9.1.A01.1.454.light.4.raw

SEQ ID NO: 562702 - DNA, 490 bp, Homo sapiens
  misc_feature: HIJSMM301C9XQR.10.25.C03.1.454.light.4.raw
catagtagtgcacgaccggtgctcgatttagtagtgtagatttgggtttggggagagctctggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggcaaacagccaccctctcctgctgggccagtccgagtgttggcagccgcttagcctggtaccagcaaaacctggccagcctcccaggctcctcgtctatggtgcatccacaagggccactggtatcccagccaggttcagtggcagtgggtctgggacagagttcgctctcaccatcagcagtctgcagtctgaagattttgcagtttattactgttcaggaatatgatggctggcctccgtacacttttgaccaaggaccaagttggacatcaaacgaactgtgg

SEQ ID NO: 562703 - DNA, 486 bp, Homo sapiens; identical to SEQ ID NO: 535043
  misc_feature: HIJSMM301DLIBY.46.35.D02.1.454.light.4.raw

SEQ ID NO: 562704 - DNA, 486 bp, Homo sapiens; identical to SEQ ID NO: 560708
  misc_feature: HIJSMM301EDP29.4.33.C11.1.454.light.4.raw

SEQ ID NO: 562705 - DNA, 499 bp, Homo sapiens
  misc_feature: HIJSMM301AG5PF.4.59.F04.1.454.light.4.raw
agcactgtagcacgaccggtgctcgatttagtacacacacttagggattgggggaggaactgctcagttaggacccagacggaaccatggaagccccagcgcagcttctcttcctcctgctactctggctcccagataccactggagaaataatattgacgcagtctccagccaccctgtctgtgtctccaggggaaagagccaccctctcctgcagggccagtcagagtgttagcagcaacttagcctggtaccagcagaagcctggccagactcccaggctcctcatctttggtgcattcaccagggccactgatatcccaaccaggttcagcggcagtgggtctgggacagagttcactctcaccatcagcaacctgcagtctgaagattctgcagtttattattgtcaccagtattatagttggcctccgtggacgttcggccaagggaccgaaggtaggaaatacaaacgaactgtggctgcaccatctgtctt

SEQ ID NO: 562706 - DNA, 487 bp, Homo sapiens
  misc_feature: HIJSMM301A6YN5.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccgggtggggctgaggatgttggcatttattactgcatgcaggctatacaccttcctgccacttttggccagggaccaagctggagatcaggcgtaacg

SEQ ID NO: 562707 - DNA, 523 bp, Homo sapiens
  misc_feature: HIJSMM301CYI6N.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaacttggcgtcgcgaccaactctcgtcgttctactcttcccgtcccactcttcg

SEQ ID NO: 562708 - DNA, 516 bp, Homo sapiens; identical to SEQ ID NO: 545737
  misc_feature: HIJSMM301DC47X.17.33.C11.1.454.light.4.raw

SEQ ID NO: 562709 - DNA, 502 bp, Homo sapiens; identical to SEQ ID NO: 536253
  misc_feature: HIJSMM301ES2QV.21.22.B11.1.454.light.4.raw

SEQ ID NO: 562710 - DNA, 510 bp, Homo sapiens
  misc_feature: HIJSMM301DOVBS.19.59.F04.1.454.light.4.raw
tactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggaagaatttttgtgtcctggtaccagcagctcccaggaacagcccccaaactcctcattttgacaataataagcgaccctcagggattcctgaccgattctctggctccaagtctggcacgtcagccaccctgggcatcaccggactccagactggggacgaggccgattattactgcggaacatgggatagcagcctgagtactgtgataatcggcggagggaccaagctgaccgtcctaggtcagcccaaggctgccccctcggtcactctgttcccg

SEQ ID NO: 562711 - DNA, 484 bp, Homo sapiens
  misc_feature: HIJSMM301DH1YR.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctcaggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaaggtggagatcaaacgaa

SEQ ID NO: 562712 - DNA, 487 bp, Homo sapiens; identical to SEQ ID NO: 538190
  misc_feature: HIJSMM301AW2O2.47.70.G04.1.454.light.4.raw

SEQ ID NO: 562713 - DNA, 493 bp, Homo sapiens; identical to SEQ ID NO: 535084
  misc_feature: HIJSMM301E0DIZ.47.64.F09.1.454.light.4.raw

SEQ ID NO: 562714 - DNA, 502 bp, Homo sapiens; identical to SEQ ID NO: 550892
  misc_feature: HIJSMM301BHN1P.19.85.H08.1.454.light.4.raw

SEQ ID NO: 562715 - DNA, 465 bp, Homo sapiens
  misc_feature: HIJSMM301EF825.48.59.F04.1.454.light.4.raw
agtatacatacacgaccggtgctcgatttagtacacacacttagggattggggagagctgctcagttagtacccagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttcccgccatctgatatgtatact

SEQ ID NO: 562716 - DNA, 497 bp, Homo sapiens
  misc_feature: HIJSMM301D7EZB.41.82.H05.1.454.light.4.raw
tctatactatcacgaccggtgctcgatttagtcgagctctctcgcgggggagtcagacccagtcaggacacagcatgaacatgagggtccccgctcagctcctggggctcctgctgctctggctcccaggtgccaagtgtgacatccagatgacccagtctccttccaccctggctgcatctgtaggagacagagtcaccatcacttgccgggccagtcagagtattagtacctggttggcctggtatcagcagaaaccagggaaagcccctaagttcctgatatataaggcgtctagtttagaaagtggggtcccatcaaggatcagcggcagtggatctgggacagaattcactctcaccattagtagcctgcagcctgatgattttgcaacttattactgccaacaatataatgatttcgtggacgttcggccaaggaccaaggtagaaatacaaacgaactagtggctgcaccatctgtcttcatcttccccg

SEQ ID NO: 562717 - DNA, 515 bp, Homo sapiens
  misc_feature: HIJSMM301B22KO.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgtcgtccacgggaccgacacgtagaaatagagacgaactacgtggcgtggtcaccactactgtcttctacttcttccccgt

SEQ ID NO: 562718 - DNA, 485 bp, Homo sapiens; identical to SEQ ID NO: 535606
  misc_feature: HIJSMM301ELOT7.47.46.E02.1.454.light.4.raw

SEQ ID NO: 562719 - DNA, 501 bp, Homo sapiens; identical to SEQ ID NO: 557427
  misc_feature: HIJSMM301C525U.17.27.C05.1.454.light.4.raw

SEQ ID NO: 562720 - DNA, 501 bp, Homo sapiens
  misc_feature: HIJSMM301DOBJM.40.42.D09.1.454.light.4.raw
tctagcgactcacgaccggtgctcgatttagacacatacgcagggaaagggggtgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagaagcattgaccaaaaaaaatatgcttattggtaccaacagaagtcaggccaggcccctgtgctggtcatctatgaggacaacaaacgaccctccgagatccctgagagattctctggctccagctcagggacaatggccaccttggctctcagtggggcccaggtggaggatgaagctgactactactgttactcagtggacagcagtggaaatcatggggtattcggcggagggaccaagctgaccgtcctaggtcagcccaaggctgcccctcggtcact

SEQ ID NO: 562721 - DNA, 503 bp, Homo sapiens
  misc_feature: HIJSMM301DYWIX.16.86.H09.1.454.light.4.raw
tgtactactccacgaccggtgctcgatttagtgctatagacttggggtttggggggggtcgtcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcggcggtgggaccaagctgaccgtcctaggtcagcccaaggctgccccccg

SEQ ID NO: 562722 - DNA, 518 bp, Homo sapiens
  misc_feature: HIJSMM301C230W.48.17.B06.1.454.light.4.raw
agtatacatacacgaccggtgctcgatttagtcgatagtgaaggggggggtcgacaagaggcagcgctctcgggacgtctccaccatggcctgggctctgctgctcctcaccctcctcactcaggacacagggtcctgggcccaggctgccctgactcagccagcctccgtgtctgcctctcctggacagtcggtcaatctttcctgcactggaaccgcctatgacattggaaaatataaccttgtctcctggtaccagcaacacccaggcaaagcccccaaattaattatttatacggtcaataagagaccgtcaggggtctctgctcgcttctctgggtccaagtctggcgacacggcctccctcacaatctctgggctccaggctgacgacgaggcttcctattgctgctcctcatatgtaggatccggctcttatctgattttcggcggagggaccaagctgaccgtcctacgtcagcccaaggctgccccctcggtcactctgttcccaccct

SEQ ID NO: 562723 - DNA, 484 bp, Homo sapiens
  misc_feature: HIJSMM301AO7GD.48.57.F02.1.454.light.4.raw
agtatacatacacgaccggtgctcgatttagctcgatatagttgggtttggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggtcggagggaccaacgctgaccgtcctaacgtacagaccccg

SEQ ID NO: 562724 - DNA, 508 bp, Homo sapiens; identical to SEQ ID NO: 541327
  misc_feature: HIJSMM301CPLVU.47.85.H08.1.454.light.4.raw

SEQ ID NO: 562725 - DNA, 492 bp, Homo sapiens; identical to SEQ ID NO: 535126
  misc_feature: HIJSMM301DKXGG.18.11.A11.1.454.light.4.raw

SEQ ID NO: 562726 - DNA, 504 bp, Homo sapiens; identical to SEQ ID NO: 539690
  misc_feature: HIJSMM301EM3WC.47.65.F10.1.454.light.4.raw

SEQ ID NO: 562727 - DNA, 481 bp, Homo sapiens
  misc_feature: HIJSMM301EVD54.48.45.E01.1.454.light.4.raw
agtatacatacacgaccggtgctcgatttagtgagtcagtaagggaaagggggggtcgtcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtgctaatacctatgtctcctggtaccaacaacacgcaggcaaagcccccaaactcatgatttatgatgtcactaagcggccctcaggggtccctgctcgcttctctggctccaagtctggcaacacggcctccctgaccatctctgggctcccaggctgaagatgaggctgattatttctgctgctcatatgcagccaactattatgtcttcggaactgagaccaaggtcaccgtcctaggtcag

SEQ ID NO: 562728 - DNA, 447 bp, Homo sapiens
  misc_feature: HIJSMM301BZC6S.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgatttattactgccaggcccttgacaacagtttgggtgtttgggtgttcggcggagggaccaagctgaccgtcctaagtcagcccaaggctcgccccctcggtcactctcgttcccgccctcctccgtgtctgat

SEQ ID NO: 562729 - DNA, 487 bp, Homo sapiens; identical to SEQ ID NO: 538190
  misc_feature: HIJSMM301EU93D.47.70.G04.1.454.light.4.raw

SEQ ID NO: 562730 - DNA, 520 bp, Homo sapiens
  misc_feature: HIJSMM301DQFOT.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggtccgaacgggaccgaacggtaggaaggtacgaaacgaactagtggcgtgcaccatctgtcttcatctccgtccactctat

SEQ ID NO: 562731 - DNA, 513 bp, Homo sapiens
  misc_feature: HIJSMM301EVWRG.5.58.F03.1.454.light.4.raw
atcagacacgcacgaccggtgctcgatttagtctgatcgagaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcacacttttatgtttcgggactgggaccaaggtcaccgtcctaggtcagccccaaggccaaccccactgtcactctcg

SEQ ID NO: 562732 - DNA, 493 bp, Homo sapiens; identical to SEQ ID NO: 536032
  misc_feature: HIJSMM301ED24H.22.57.F02.1.454.light.4.raw

SEQ ID NO: 562733 - DNA, 512 bp, Homo sapiens
  misc_feature: HIJSMM301DGRVY.17.33.C11.1.454.light.4.raw
  modified_base (505)..(505): a, c, t, g, unknown or other
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcgagggaccaagctgaccgtcttaagtcagcccaaggctgccccctcggtcactctgttcccnccctcct

SEQ ID NO: 562734 - DNA, 493 bp, Homo sapiens; identical to SEQ ID NO: 536969
  misc_feature: HIJSMM301CH646.27.78.H01.1.454.light.4.raw

SEQ ID NO: 562735 - DNA, 488 bp, Homo sapiens
  misc_feature: HIJSMM301A4P2Z.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaggcggagatcagacgaactgtggctgcaccatctgtctact

SEQ ID NO: 562736 - DNA, 513 bp, Homo sapiens
  misc_feature: HIJSMM301DJKU9.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctcggtcactctgttcccaccctcctcgctacgtaga

SEQ ID NO: 562737 - DNA, 502 bp, Homo sapiens; identical to SEQ ID NO: 536253
  misc_feature: HIJSMM301DEVG0.21.22.B11.1.454.light.4.raw

SEQ ID NO: 562738 - DNA, 490 bp, Homo sapiens; identical to SEQ ID NO: 536481
  misc_feature: HIJSMM301AIB3X.13.46.E02.1.454.light.4.raw

SEQ ID NO: 562739 - DNA, 496 bp, Homo sapiens; identical to SEQ ID NO: 539396
  misc_feature: HIJSMM301ADZKX.51.39.D06.1.454.light.4.raw

SEQ ID NO: 562740 - DNA, 494 bp, Homo sapiens; identical to SEQ ID NO: 534992
  misc_feature: HIJSMM301A418K.9.1.A01.1.454.light.4.raw

SEQ ID NO: 562741 - DNA, 416 bp, Homo sapiens; identical to SEQ ID NO: 539343
  misc_feature: HIJSMM301DMGOV.18.78.H01.1.454.light.4.raw

SEQ ID NO: 562742 - DNA, 447 bp, Homo sapiens; identical to SEQ ID NO: 535201
  misc_feature: HIJSMM301CYF2Y.18.9.A09.1.454.light.4.raw

SEQ ID NO: 562743 - DNA, 486 bp, Homo sapiens; identical to SEQ ID NO: 536555
  misc_feature: HIJSMM301CPZG3.26.23.C01.1.454.light.4.raw

SEQ ID NO: 562744 - DNA, 476 bp, Homo sapiens; identical to SEQ ID NO: 538611
  misc_feature: HIJSMM301BHEUQ.7.81.H04.1.454.light.4.raw

SEQ ID NO: 562745 - DNA, 501 bp, Homo sapiens; identical to SEQ ID NO: 536818
  misc_feature: HIJSMM301CHK8W.12.82.H05.1.454.light.4.raw

SEQ ID NO: 562746 - DNA, 447 bp, Homo sapiens; identical to SEQ ID NO: 535201
  misc_feature: HIJSMM301DV6MP.18.9.A09.1.454.light.4.raw

SEQ ID NO: 562747 - DNA, 502 bp, Homo sapiens; identical to SEQ ID NO: 536604
  misc_feature: HIJSMM301A8X3C.27.78.H01.1.454.light.4.raw

SEQ ID NO: 562748 - DNA, 482 bp, Homo sapiens; identical to SEQ ID NO: 540521
  misc_feature: HIJSMM301AEH9O.21.25.C03.1.454.light.4.raw

SEQ ID NO: 562749 - DNA, 489 bp, Homo sapiens; identical to SEQ ID NO: 543809
  misc_feature: HIJSMM301CDNMV.19.71.G05.1.454.light.4.raw

SEQ ID NO: 562750 - DNA, 479 bp, Homo sapiens
  misc_feature: HIJSMM301BFUKH.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtggtccgctcattttcggcggagggaccaaggtgcagatcaaacgaactgtgg

SEQ ID NO: 562751 - DNA, 485 bp, Homo sapiens; identical to SEQ ID NO: 539315
  misc_feature: HIJSMM301EDNWU.3.88.H11.1.454.light.4.raw

SEQ ID NO: 562752 - DNA, 493 bp, Homo sapiens; identical to SEQ ID NO: 535614
  misc_feature: HIJSMM301B93OS.9.1.A01.1.454.light.4.raw

SEQ ID NO: 562753 - DNA, 485 bp, Homo sapiens; identical to SEQ ID NO: 535985
  misc_feature: HIJSMM301AI6EO.15.1.A01.1.454.light.4.raw

SEQ ID NO: 562754 - DNA, 492 bp, Homo sapiens; identical to SEQ ID NO: 537314
  misc_feature: HIJSMM301B8CGS.14.53.E09.1.454.light.4.raw

SEQ ID NO: 562755 - DNA, 485 bp, Homo sapiens
  misc_feature: HIJSMM301AZ6AV.52.23.C01.1.454.light.4.raw
cgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaactatttaaattggtatcagcagaaaccagggaaagcccctaaactcctgatctacgatgcatccaatttggagacaggggtcccatcaaggttcactggaagtggatctgggacacattttactttcaccatcagcggcctgcagcctgaagattttgcaacatattactgtcaacaatatgaagatctccccctcactttcggcggagggaccgaaggtggagatcagacgaactgtggctgcaccat

SEQ ID NO: 562756 - DNA, 499 bp, Homo sapiens; identical to SEQ ID NO: 538643
  misc_feature: HIJSMM301EWZP0.48.1.A01.1.454.light.4.raw

SEQ ID NO: 562757 - DNA, 500 bp, Homo sapiens; identical to SEQ ID NO: 546615
  misc_feature: HIJSMM301A7K4W.15.37.D04.1.454.light.4.raw

SEQ ID NO: 562758 - DNA, 504 bp, Homo sapiens
  misc_feature: HIJSMM301ETZ8Z.52.27.C05.1.454.light.4.raw
cgcagtacgacacgaccggtgctcgatttagacgcgatcgaagggtttggggagtctcagtcaggacacagcatggacatgagggtccccgctcagctcctggggctcctgctactctggctccgaggtgccagatgtgacacccagatgacccagtctccatcctccctgtctgcatctgtaggagacagagtcaccatcacgtgccgggcaagtcagagcattggcaggtatttaaattggtatcaacagaaaccagggaaagcccctaggctcctgatctatgctgcatcccgtttgcaaagtggggtcccgtcaaggttcagtggccgtggatctgggacagatttcactctcaccatcagcagtctccaacctgaagattttgcaatttactactgtcaacagagtgacaataccccctcagactttcggccctcgggaccgacgagtaggagtaattacaaacgaaactagtggcgtgcaccactctcgtcttctatt

SEQ ID NO: 562759 - DNA, 490 bp, Homo sapiens
  misc_feature: HIJSMM301AIRYO.19.71.G05.1.454.light.4.raw
tactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaactgtgg

SEQ ID NO: 562760 - DNA, 507 bp, Homo sapiens; identical to SEQ ID NO: 547790
  misc_feature: HIJSMM301D6BDA.21.87.H10.1.454.light.4.raw

SEQ ID NO: 562761 - DNA, 495 bp, Homo sapiens
  misc_feature: HIJSMM301AHJHK.53.42.D09.1.454.light.4.raw
cgcgtatacacacgaccggtgctcgatttagacacatacgcagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcact

SEQ ID NO: 562762 - DNA, 482 bp, Homo sapiens; identical to SEQ ID NO: 536622
  misc_feature: HIJSMM301EQESY.7.85.H08.1.454.light.4.raw

SEQ ID NO: 562763 - DNA, 483 bp, Homo sapiens
  misc_feature: HIJSMM301EDYQJ.16.81.H04.1.454.light.4.raw
tgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaactttcggccctgggaccaatagtggatatcaaacgaactgtggctgcaccatctgtt

SEQ ID NO: 562764 - DNA, 489 bp, Homo sapiens; identical to SEQ ID NO: 536663
  misc_feature: HIJSMM301EL9X2.16.72.G06.1.454.light.4.raw

SEQ ID NO: 562765 - DNA, 506 bp, Homo sapiens
  misc_feature: HIJSMM301B3WK8.8.71.G05.1.454.light.4.raw
ctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccagggaaagcccctaaatacctggtctatactgcatccactttgcaaagtggggtcccatcaaggttcagtggcagtggatttgggacagttttcactctcacaatcagcagtctcgaacctgaagattttgcaacttactactgtcaacagacttacaatataccgaggacgttcggtcaagggaccaaaggtggagatcaaacgaactgtggctgcaccatctgccttcatcttcccgccat

SEQ ID NO: 562766 - DNA, 512 bp, Homo sapiens; identical to SEQ ID NO: 539813
  misc_feature: HIJSMM301B2NTS.14.7.A07.1.454.light.4.raw

SEQ ID NO: 562767 - DNA, 473 bp, Homo sapiens; identical to SEQ ID NO: 535262
  misc_feature: HIJSMM301BIQEO.8.67.G01.1.454.light.4.raw

SEQ ID NO: 562768 - DNA, 510 bp, Homo sapiens
  misc_feature: HIJSMM301ALW26.4.27.C05.1.454.light.4.raw
agcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggccctcagggatccctgagcgcttctctggatccaactctgggaacacagccactctgaccatcagcgggacccaacttttagatgaggccgactatttctgtcacacgtgggacatgggcactgcgatcttcggcggagggaccaagttcgacgtcctcgggtcgagcccaacggacgtcgcccccgtccggtccgacctcttcg

SEQ ID NO: 562769 - DNA, 502 bp, Homo sapiens
  misc_feature: HIJSMM301CMU1I.21.81.H04.1.454.light.4.raw
tcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacgaggctgattattactgcaggtcatatacaatcagcaacacttatgtcttcgggactgggaccaagatcacgtcctaggtcagcccaaggccaaccccactgtcta

SEQ ID NO: 562770 - DNA, 417 bp, Homo sapiens; identical to SEQ ID NO: 549984
  misc_feature: HIJSMM301B1H6B.10.86.H09.1.454.light.4.raw

SEQ ID NO: 562771 - DNA, 480 bp, Homo sapiens; identical to SEQ ID NO: 535291
  misc_feature: HIJSMM301D7E47.22.59.F04.1.454.light.4.raw

SEQ ID NO: 562772 - DNA, 498 bp, Homo sapiens
  misc_feature: HIJSMM301BR4KP.40.70.G04.1.454.light.4.raw
tctagcgactcacgaccggtgctcgatttagtgtagtgtgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccggagtgttttgtacagctccaacaataagaattacttagcttggtatcagcagagaccagggcagcctcctaagttgctcatttactgggcatctacccgggaatccggggtccctgaccgattcagtggcagcgggtctgggacagatttcactctcaccatcagcagcctgcaggctgaagatgtggcactttattactgtcagcaatattttagtattccgttcactttcggcggagggaccaaggtggagatcaaacgaactgtggctgcacc

SEQ ID NO: 562773 - DNA, 485 bp, Homo sapiens
  misc_feature: HIJSMM301BWJG6.49.83.H06.1.454.light.4.raw
agtcgagagacacgaccggtgctcgatttagatcacgtgcgtcgcgggggatcaggacttctcagttcatcttctcaccatgaggctccctgctcagctcctggggctgccaatgctctggaaacctgggtccagtgcggatattgtgatgacccagactccactctttctgtccgtcacccctggacagccggcctccatctcctgcaagtctagtcagaccctccagcatagtcttggcaagacctatttccatagtcacctgcacaagccaggccagcctccacaggtcctgatctatgatgtttccagccggttctctggagtggcggatgggttcagtggcagcgagtcagggccaggcttcacactgaaaatcagccgggtggaggctgaggatgttggggtttattattgcatgcagaggatagagatccctccgagacttttggccagggaccgagctggagatacaaacgaactgt

SEQ ID NO: 562774 - DNA, 518 bp, Homo sapiens
  misc_feature: HIJSMM301CKNWF.12.71.G05.1.454.light.4.raw
  modified_base (514)..(514): a, c, t, g, unknown or other
atacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcggaccaagtgaccgtcctaagtcagcccaaggctgccccctcggtcactctgttcccnccct

SEQ ID NO: 562775 - DNA, 490 bp, Homo sapiens
  misc_feature: HIJSMM301CWHJ5.17.43.D10.1.454.light.4.raw
  modified_base (458)..(458): a, c, t, g, unknown or other
cgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacgagccaccctctcctgcagggccagtcagagtgtgagcagcaacttagcctggtatcagcagaaacctggccaggatcccaggctcctcatctatggtgcttccaccagggccgctggtgtcccagccagattcaggggcagtgggtctgggacagagttcactctcaccatcagcagcctgcagtctgaagattttgcagtttattactgtcagcactataataactggccccgggggacgtggccgaggacgaacgtggagagtnaacgaactacgtggctgcaccactctgtcttc

SEQ ID NO: 562776 - DNA, 508 bp, Homo sapiens; identical to SEQ ID NO: 561089
  misc_feature: HIJSMM301ARR40.3.37.D04.1.454.light.4.raw

SEQ ID NO: 562777 - DNA, 480 bp, Homo sapiens; identical to SEQ ID NO: 535975
  misc_feature: HIJSMM301BQ9JO.51.60.F05.1.454.light.4.raw

SEQ ID NO: 562778 - DNA, 484 bp, Homo sapiens; identical to SEQ ID NO: 539370
  misc_feature: HIJSMM301EJDWQ.22.73.G07.1.454.light.4.raw

SEQ ID NO: 562779 - DNA, 487 bp, Homo sapiens; identical to SEQ ID NO: 536206
  misc_feature: HIJSMM301ADHEV.47.38.D05.1.454.light.4.raw

SEQ ID NO: 562780 - DNA, 482 bp, Homo sapiens; identical to SEQ ID NO: 536622
  misc_feature: HIJSMM301CGWM9.7.85.H08.1.454.light.4.raw

SEQ ID NO: 562781 - DNA, 494 bp, Homo sapiens; identical to SEQ ID NO: 534992
  misc_feature: HIJSMM301BDX1E.9.1.A01.1.454.light.4.raw

SEQ ID NO: 562782 - DNA, 512 bp, Homo sapiens
  misc_feature: HIJSMM301BJ96H.7.34.D01.1.454.light.4.raw
cgtgtctctacacgaccggtgctcgatttagatcgtctgtgttgggtttggggggggtcgtcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggactccagactgaggacgaggctgattattactgctgctcatatacaggggacagcattatttgggtgttcggcggagggaccaagctgaccgtcctgcgtcagcccaaggctgccccctcggtcact

SEQ ID NO: 562783 - DNA, 478 bp, Homo sapiens
  misc_feature: HIJSMM301DGM99.12.1.A01.1.454.light.4.raw
atacgacgtacacgaccggtgctcgatttagacgtctcatcagggcacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaaggttcagtggcagtgggtctgggacagatttcactctcaccatcagcagtctgcaacctgaagattctgcaacttattactgtcaacagagtaacagttaccctcccactttcggcggagggaccaaggtggagatcaaacgaactgtggctgcaccatctgtcttcatcttcccgccta

SEQ ID NO: 562784 - DNA, 499 bp, Homo sapiens
  misc_feature: HIJSMM301BF9RO.40.23.C01.1.454.light.4.raw
tctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtcttagcaactacttagtctggtaccaacagaaacctggccaggctcccaggctcctcatctatgatgcatccagcagggccactggcatcccagccaggttcagtggcagtgggtctgggacagacttcactctcaccatcagcggcctagagcctgaagactttgcagtttattactgtcagcagcgtaccaactggccgctcactttcggcggagggaccaaggtggagatcaaacgaactgtggctgcaccatctgtcttcattcc

SEQ ID NO: 562785 - DNA, 503 bp, Homo sapiens; identical to SEQ ID NO: 538884
  misc_feature: HIJSMM301CRK7W.27.78.H01.1.454.light.4.raw

SEQ ID NO: 562786 - DNA, 504 bp, Homo sapiens; identical to SEQ ID NO: 536728
  misc_feature: HIJSMM301BSFXA.19.78.H01.1.454.light.4.raw

SEQ ID NO: 562787 - DNA, 494 bp, Homo sapiens; identical to SEQ ID NO: 534994
  misc_feature: HIJSMM301D4RDA.27.78.H01.1.454.light.4.raw

SEQ ID NO: 562788 - DNA, 516 bp, Homo sapiens
  misc_feature: HIJSMM301BINAB.41.25.C03.1.454.light.4.raw
tctatactatcacgaccggtgctcgatttagtagtgtagatttgggtttggggatagctcaggaagcagagcctggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctggggtcccctttcggttttctggctccatcgacagtccctccaactccgcctcccttaccatatctgggctgaagagtgaggacgaggctgactacttctgtcagtcttatgatataacaattatgtgataattggcggagggaccagggtgaccgtcctaggtcagcccaaggctgccccctcggtcactctgtcccta

SEQ ID NO: 562789 - DNA, 517 bp, Homo sapiens
  misc_feature: HIJSMM301AXQLJ.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggctgccccctcggtcactctgtcccgccctcctcacg

SEQ ID NO: 562790 - DNA, 494 bp, Homo sapiens
  misc_feature: HIJSMM301EDTY7.40.9.A09.1.454.light.4.raw
  modified_base (370)..(370): a, c, t, g, unknown or other
tctagcgactcacgaccggtgctcgatttagcgagacgcgcagggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagcgttttatccacttcctacaatcagaattacttagcttggtatcagcataaaccagggcagcctccgaggctgctcatttactggacatctatccgggaatccggggtccctgaccgattccgtggcagtgggtctgggacagattttacnctcaccatcaccagccttcaggctgaagatgtggcagtttattactgtcaccaatatttagacattcctccgacgttcggccaagggaccaaggtggagatcaaacgaactgtggctgcaccat

SEQ ID NO: 562791 - DNA, 493 bp, Homo sapiens; identical to SEQ ID NO: 554221
  misc_feature: HIJSMM301C1FS4.9.1.A01.1.454.light.4.raw

SEQ ID NO: 562792 - DNA, 505 bp, Homo sapiens; identical to SEQ ID NO: 543569
  misc_feature: HIJSMM301CDDVY.10.12.B01.1.454.light.4.raw

SEQ ID NO: 562793 - DNA, 513 bp, Homo sapiens
  misc_feature: HIJSMM301EQDY1.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggccgaacggaccgaacggtaggaagtacaaacgaactagtggcgtgcaccatctgtcttctatcttcccgccact

SEQ ID NO: 562794 - DNA, 470 bp, Homo sapiens
  misc_feature: HIJSMM301EH7JN.5.70.G04.1.454.light.4.raw
atcagacacgcacgaccggtgctcgatttagtgtagtgtgaagggaaagggggcaggagtcagacccagtcaggacacagcatggacatgagggtccccgctcagctcctggggctcctgctgctctggttcccaggttccagttgcgacatccagatgacccagtctccatcttccgtgtctgcatctgtgggagacagagtcaccatcacttgtcgggcgagtcagggtgttagcagctggttagcctggtatcagcagaaaccagggaaagcccctaagctcctgatctatgctgcatccatcttgcagagtggggtcccatcaaggttcatcggcagtggatctgggacagatttcactctcaccatcagcagcctgcagcctgaagattttgcaacttactttgtcaacaggctcagatttcccgctcactttcggcggagggaccaaggtggagatcaaacgaa

SEQ ID NO: 562795 - DNA, 521 bp, Homo sapiens; identical to SEQ ID NO: 539470
  misc_feature: HIJSMM301CS7DO.27.23.C01.1.454.light.4.raw

SEQ ID NO: 562796 - DNA, 493 bp, Homo sapiens; identical to SEQ ID NO: 537281
  misc_feature: HIJSMM301AZEF2.9.1.A01.1.454.light.4.raw

SEQ ID NO: 562797 - DNA, 478 bp, Homo sapiens; identical to SEQ ID NO: 538527
  misc_feature: HIJSMM301AQF3N.13.34.D01.1.454.light.4.raw

SEQ ID NO: 562798 - DNA, 483 bp, Homo sapiens; identical to SEQ ID NO: 549960
  misc_feature: HIJSMM301EU9DN.3.88.H11.1.454.light.4.raw

SEQ ID NO: 562799 - DNA, 516 bp, Homo sapiens
  misc_feature: HIJSMM301EBPPK.48.14.B03.1.454.light.4.raw
agtatacatacacgaccggtgctcgatttagtgtgagtagttccgcgggggatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaagtaaaaatggaaacatttacttacattggtttcaacagaggccaggccagtctccaaggcgcctgatttatgacgtttttaaacgggagtctggggtcccagacagattcagcggcagtgggtcagacactgacttcacactgagaatcagcagggttgaggctgaggatgttggcacttattactgcatgcaaggctcacactggcctccgtggacgttcggccaagggacccgggtggaataaaacgaactagtggctgcaccatctgtcttcatcttccccg

SEQ ID NO: 562800 - DNA, 490 bp, Homo sapiens; identical to SEQ ID NO: 543909
  misc_feature: HIJSMM301AST5Y.14.55.E11.1.454.light.4.raw

SEQ ID NO: 562801 - DNA, 464 bp, Homo sapiens
  misc_feature: HIJSMM301CWZL1.10.86.H09.1.454.light.4.raw
catagtagtgcacgaccggtgctcgatttagtgctatagacttgggtttgggaacctatgaacattctgtaggggcccagtctttgttgacgcagccgccctcagtgtctgcggccccaggacagagggtcaccgtctcctgctctggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccagaccggggacgaggccgattattactgcgcaacttgggactccaacctgactgttggggctttcggcggagggactaagttgaccgtcctacgtcagcccaaggctgccccctcggtcactctgttcccgccctcctccactactatg

SEQ ID NO: 562802 - DNA, 504 bp, Homo sapiens; identical to SEQ ID NO: 549053
  misc_feature: HIJSMM301DWSBD.4.71.G05.1.454.light.4.raw

SEQ ID NO: 562803 - DNA, 490 bp, Homo sapiens; identical to SEQ ID NO: 546232
  misc_feature: HIJSMM301CN9MU.51.28.C06.1.454.light.4.raw

SEQ ID NO: 562804 - DNA, 513 bp, Homo sapiens
  misc_feature: HIJSMM301DH0JH.10.80.H03.1.454.light.4.raw
catagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctgtgggggagacagcattgaaagtgaagctgtccactggtaccagcagaggccaggccaggcccctgtactggtcctctatgatgatagtgaccggccctcagggatccctgagcgattctctggctccaactctgggaacacggccaccctgaccatcaccagggtcgaagccggggatgaggccgactattattgtcaggtgtggtatttcagtagtattcatccgggggttttcggcggagggaccaagctgaccgtcctaggtcagcccaaggctgccccctcggtcactctgttcccg

SEQ ID NO: 562805 - DNA, 487 bp, Homo sapiens
  misc_feature: HIJSMM301BWCBW.43.36.D03.1.454.light.4.raw
tgtgagtagtcacgaccggtgctcgatttagctgcgtcacgatctctcttgggggagctacaacaggcaggcaggggcagcaagatggtgttgcagacccaggtcttcatttctctgttgctctggatctctggtgccttcggggacatcgtgatgacccagtctccaggttccctggctgtctctctgggcgagagggccacgctcaagtgcacctccagcgagagtgtgttgtactccccccacccatcagcacgccttagcctggtaccagcacaagtcagggcagcctcctaagttgctcttttactggacttcgatccgcgcatctggggtccctgaccgattcatgggcagcggctctgggacagacttcgctctcaccatcaacagcctccaggctgaggatgcggcggtttattattgtcaacaatattttagtgctccgtacacttttggccaggggaccaagttggagatcaaacga

SEQ ID NO: 562806 - DNA, 498 bp, Homo sapiens; identical to SEQ ID NO: 537020
  misc_feature: HIJSMM301DF1MX.26.26.C04.1.454.light.4.raw

SEQ ID NO: 562807 - DNA, 497 bp, Homo sapiens
  misc_feature: HIJSMM301DV70F.26.80.H03.1.454.light.4.raw
agactatactcacgaccggtgctcgatttagctgtgcgtcgaagggaaagggactgactaccacctgcaggtcagggccaaggttatggggtcccaggttcacctcctcagcttcctcctcctttggatctctgagccgacactcacgcagtctccagcattcatgtcagcgactctaggagacaaggtcaacttctcctccaaagccagccaagacattgatgatgatatgaactggcaccaacacaaaccaggagaagctgctatttccattactcaagaaactaatggtctcctacctggaatgccacctcgactcagtggcaacaaatatggaacagttttaccctcacaactcatatcacagaatctgaggatgctgcattttacttcggtctacaacatgataatttccctccgtggacgttcggccaagggaccaaggagcaaatacaaacgaactgtggctgcaccatctgtcttcatcttcccgccat

SEQ ID NO: 562808 - DNA, 497 bp, Homo sapiens
  misc_feature: HIJSMM301D0R11.51.59.F04.1.454.light.4.raw
cgatcgtatacacgaccggtgctcgatttagtacacacacttagggattgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcact

SEQ ID NO: 562809 - DNA, 484 bp, Homo sapiens
  misc_feature: HIJSMM301EANVW.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgataactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaactttggccagggaccaagctggagatcaaacgaactgtggctgcaccat

SEQ ID NO: 562810 - DNA, 485 bp, Homo sapiens; identical to SEQ ID NO: 538840
  misc_feature: HIJSMM301DSDIV.19.71.G05.1.454.light.4.raw

SEQ ID NO: 562811 - DNA, 499 bp, Homo sapiens
  misc_feature: HIJSMM301EKTLA.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgcagtttattactgtcagcagtataattactggcctcggacgttcggcaacgggacgaacggtaggaaggtcaaacgaactaggtggcgtgcgaccatctgtcttt

SEQ ID NO: 562812 - DNA, 493 bp, Homo sapiens; identical to SEQ ID NO: 542616
  misc_feature: HIJSMM301DHKVY.4.27.C05.1.454.light.4.raw

SEQ ID NO: 562813 - DNA, 521 bp, Homo sapiens
  misc_feature: HIJSMM301BLT1N.10.86.H09.1.454.light.4.raw
catagtagtgcacgaccggtgctcgatttagtgctatagacttgggtttggggagctctgcttcagctgtgagcgcagaaggcgggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccagaccggggacgaggccgattattactgcgcaacttgggactccaacctgactgttggggctttcggcggagggactaagttgaccgtcctacgtcagcccaaggctgccccctcggtcta

SEQ ID NO: 562814 - DNA, 500 bp, Homo sapiens; identical to SEQ ID NO: 535310
  misc_feature: HIJSMM301BOIF6.47.66.F11.1.454.light.4.raw

SEQ ID NO: 562815 - DNA, 521 bp, Homo sapiens; identical to SEQ ID NO: 539470
  misc_feature: HIJSMM301A4R3M.27.23.C01.1.454.light.4.raw

SEQ ID NO: 562816 - DNA, 483 bp, Homo sapiens; identical to SEQ ID NO: 537371
  misc_feature: HIJSMM301ESEC4.13.55.E11.1.454.light.4.raw

SEQ ID NO: 562817 - DNA, 489 bp, Homo sapiens; identical to SEQ ID NO: 535139
  misc_feature: HIJSMM301C8N4K.14.55.E11.1.454.light.4.raw

SEQ ID NO: 562818 - DNA, 490 bp, Homo sapiens; identical to SEQ ID NO: 543909
  misc_feature: HIJSMM301BWAKM.14.55.E11.1.454.light.4.raw

SEQ ID NO: 562819 - DNA, 514 bp, Homo sapiens; identical to SEQ ID NO: 546238
  misc_feature: HIJSMM301C8SX5.47.85.H08.1.454.light.4.raw

SEQ ID NO: 562820 - DNA, 513 bp, Homo sapiens
  misc_feature: HIJSMM301ECMDO.12.53.E09.1.454.light.4.raw
atacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctgggtccgagtctggcaacacggcctccctgacaatctctgggctccaggctgaggacgaggcggattattactgttgctcatatgcgggtagtagcactttcgatgtcctattcggtcggagggaccgaagctgaccgtcctcgggtcgagcccaacggctgccccctccggtcacctctcgttcccaccctcctctacgtcgtat

SEQ ID NO: 562821 - DNA, 485 bp, Homo sapiens
  misc_feature: HIJSMM301A9W1L.17.34.D01.1.454.light.4.raw
cgtagactagcacgaccggtgctcgatttagatcgtctgtgttgggtttgggtcatcacaatatctgcactggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagctttcctccgacgttcggccaagggaccaaggtggaactcaaacgaactgtggctgcaccatctgtcttcatcttcccgccatctgactagtctacg

SEQ ID NO: 562822 - DNA, 489 bp, Homo sapiens; identical to SEQ ID NO: 559947
  misc_feature: HIJSMM301DAZ0L.5.23.C01.1.454.light.4.raw

SEQ ID NO: 562823 - DNA, 470 bp, Homo sapiens
  misc_feature: HIJSMM301CDQYP.3.82.H05.1.454.light.4.raw
agacgcactccacgaccggtgctcgatttagtcgagctctctcgcgggggagtcagacccagtcaggacacagcatggacatgagggtccccgctcagctcctgggctcctgctgctctggttcccaggttccagatgcgacatccagatgacccagtctccatcctccgtgtctgcatctgtaggggacagagtcgctatgacttgtcgggcgactcgcggttttaacagatggttagtctggtatcagcagaaaccagggaaagcccctgagttcctgatgtctgctgcatccaccctgcaaagtggagtcccatccagattcagcgtcagtgaatctgggacagagtttcactctcaccatcagcagcctgcagcctgaagattttgcaacttactattgtcaacaggctgacagtctcccgctcactttcggcggagggaccaaggtgagatcaaacgaactgtgg

SEQ ID NO: 562824 - DNA, 486 bp, Homo sapiens; identical to SEQ ID NO: 537127
  misc_feature: HIJSMM301ETOVV.3.77.G11.1.454.light.4.raw

SEQ ID NO: 562825 - DNA, 512 bp, Homo sapiens; identical to SEQ ID NO: 537564
  misc_feature: HIJSMM301D9FCN.17.33.C11.1.454.light.4.raw

SEQ ID NO: 562826 - DNA, 488 bp, Homo sapiens; identical to SEQ ID NO: 536851
  misc_feature: HIJSMM301AOV86.41.2.A02.1.454.light.4.raw

SEQ ID NO: 562827 - DNA, 506 bp, Homo sapiens
  misc_feature: HIJSMM301AVF96.14.3.A03.1.454.light.4.raw
cgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctggtaccaacagcacccaggcaaagcccccaaactcattatttatgaggtcaataatcggccctcaggagtttctaatcgcttctctggctccaagtctggcaacacggcctccctgagcatctctgggctccaggctgaggacgagggctgattattactgcagctcatatactattagcagaactgtggttttcggcggagggaccaaggtgaccgtcctaggtcagcccaaggctgccccctcggtcactctcg

SEQ ID NO: 562828 - DNA, 484 bp, Homo sapiens; identical to SEQ ID NO: 536162
  misc_feature: HIJSMM301AOR1T.13.59.F04.1.454.light.4.raw

SEQ ID NO: 562829 - DNA, 496 bp, Homo sapiens; identical to SEQ ID NO: 537925
  misc_feature: HIJSMM301CS7IC.22.14.B03.1.454.light.4.raw

SEQ ID NO: 562830 - DNA, 501 bp, Homo sapiens
  misc_feature: HIJSMM301B6O1G.18.23.C01.1.454.light.4.raw
tacgagtatgcacgaccggtgctcgatttagtacacgtgattagggattgggggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaagcccctaagctgcagatgattggtccgtccagtttccaagatggggccccatcgagattccgcgtcagtggatctgggacagatttcactctcaccatcagcagcctgcagcctgaagattttgcaacttactattgtcagcaggcgcacaatttcccgctcactttcggcggaggaccaaggtggagatcaaacgaactgtggctgcaccatctgtcttcatcttccccg

SEQ ID NO: 562831 - DNA, 484 bp, Homo sapiens; identical to SEQ ID NO: 535211
  misc_feature: HIJSMM301A0INK.47.46.E02.1.454.light.4.raw

SEQ ID NO: 562832 - DNA, 488 bp, Homo sapiens; identical to SEQ ID NO: 537329
  misc_feature: HIJSMM301BAH7P.26.23.C01.1.454.light.4.raw

SEQ ID NO: 562833 - DNA, 509 bp, Homo sapiens
  misc_feature: HIJSMM301APLT9.43.67.G01.1.454.light.4.raw
tgtgagtagtcacgaccggtgctcgatttagagtatacatattgggtttgggggagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgttatactccgccgacgttcggccgggggaccgaccgtggaaatcaaacgaactgtggctgcaccatctgtctt

SEQ ID NO: 562834 - DNA, 467 bp, Homo sapiens; identical to SEQ ID NO: 535997
  misc_feature: HIJSMM301BA3YA.5.36.D03.1.454.light.4.raw

SEQ ID NO: 562835 - DNA, 460 bp, Homo sapiens; identical to SEQ ID NO: 536053
  misc_feature: HIJSMM301B60IQ.22.28.C06.1.454.light.4.raw

SEQ ID NO: 562836 - DNA, 502 bp, Homo sapiens
  misc_feature: HIJSMM301AWMJF.10.9.A09.1.454.light.4.raw
catagtagtgcacgaccggtgctcgatttagcgagacgcgcaggggcagagccctggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggccgtccgggggccactttcggccctgggaccaagtggagatcaaacgaactgtggctgcacca

SEQ ID NO: 562837 - DNA, 488 bp, Homo sapiens; identical to SEQ ID NO: 542699
  misc_feature: HIJSMM301ASVG4.12.51.E07.1.454.light.4.raw

SEQ ID NO: 562838 - DNA, 488 bp, Homo sapiens; identical to SEQ ID NO: 536861
  misc_feature: HIJSMM301AOYLJ.12.88.H11.1.454.light.4.raw

SEQ ID NO: 562839 - DNA, 487 bp, Homo sapiens; identical to SEQ ID NO: 536536
  misc_feature: HIJSMM301D3NZO.26.45.E01.1.454.light.4.raw

SEQ ID NO: 562840 - DNA, 496 bp, Homo sapiens
  misc_feature: HIJSMM301CYIDC.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctactcttttctctttcggaactgggaccacggtcaccgtcctaggtcagcccaaggccaaccca

SEQ ID NO: 562841 - DNA, 497 bp, Homo sapiens
  misc_feature: HIJSMM301AMX0B.16.46.E02.1.454.light.4.raw
tgtactactccacgaccggtgctcgatttagactcatctacagggaaaggggctgtgcctgggctctgctcctcctcaccctcctcactcagggcacaggatcctgggctcagtctgccccgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaaccccactgtcactctgttcccaccctcctcgagtagtaca

SEQ ID NO: 562842 - DNA, 510 bp, Homo sapiens
  misc_feature: HIJSMM301BF28A.47.83.H06.1.454.light.4.raw
agctcacgtacacgaccggtgctcgatttagatcacgtgcgtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctcgccccctcggtcactctgtt

SEQ ID NO: 562843 - DNA, 485 bp, Homo sapiens; identical to SEQ ID NO: 536799
  misc_feature: HIJSMM301EX6SJ.19.71.G05.1.454.light.4.raw

SEQ ID NO: 562844 - DNA, 484 bp, Homo sapiens; identical to SEQ ID NO: 535297
  misc_feature: HIJSMM301DEYCN.10.35.D02.1.454.light.4.raw

SEQ ID NO: 562845 - DNA, 495 bp, Homo sapiens; identical to SEQ ID NO: 535596
  misc_feature: HIJSMM301CRBKZ.10.79.H02.1.454.light.4.raw

SEQ ID NO: 562846 - DNA, 513 bp, Homo sapiens; identical to SEQ ID NO: 535244
  misc_feature: HIJSMM301BXEKY.17.33.C11.1.454.light.4.raw

SEQ ID NO: 562847 - DNA, 454 bp, Homo sapiens; identical to SEQ ID NO: 534964
  misc_feature: HIJSMM301BB3L3.19.86.H09.1.454.light.4.raw

SEQ ID NO: 562848 - DNA, 488 bp, Homo sapiens
  misc_feature: HIJSMM301BWJI8.53.4.A04.1.454.light.4.raw
cgcgtatacacacgaccggtgctcgatttagagtagtgatcaggggaggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggttatcatctcctgcactgggaccagctccaacatcgggtcaggttatgatgtacactggtaccagcagcttccaggaacagcccccaaactcctcgtctatggtgacggcagtcggccctcaggggtccctggccgattctctggctccaagtctggcacctcagcctccctggccatcactgggctccaggctgaggatgagggtcattattactgccagtcctatgacaacagaatggatccttcttgggtgttcggcggagggaccaagctgacccg

SEQ ID NO: 562849 - DNA, 495 bp, Homo sapiens; identical to SEQ ID NO: 538549
  misc_feature: HIJSMM301DANFX.12.87.H10.1.454.light.4.raw

SEQ ID NO: 562850 - DNA, 490 bp, Homo sapiens
  misc_feature: HIJSMM301BW1DN.16.86.H09.1.454.light.4.raw
tgtactactccacgaccggtgctcgatttagtgctatagacttgggtttgggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaacgcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcggcggtgggaccaagctgaccgtctaggtcagccc

SEQ ID NO: 562851 - DNA, 500 bp, Homo sapiens
  misc_feature: HIJSMM301D6OR6.19.78.H01.1.454.light.4.raw
tactctcgtgcacgaccggtgctcgatttagtgtgagtagtttgggtttgggggctttatttgggctctgctgctcctcactctactcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggcccaaccccactgtcactctgttcccaccctcctccacgagagta

SEQ ID NO: 562852 - DNA, 487 bp, Homo sapiens; identical to SEQ ID NO: 537573
  misc_feature: HIJSMM301AEC19.3.10.A10.1.454.light.4.raw

SEQ ID NO: 562853 - DNA, 415 bp, Homo sapiens; identical to SEQ ID NO: 536118
  misc_feature: HIJSMM301DNC3K.18.78.H01.1.454.light.4.raw

SEQ ID NO: 562854 - DNA, 484 bp, Homo sapiens; identical to SEQ ID NO: 539605
  misc_feature: HIJSMM301ET671.46.26.C04.1.454.light.4.raw

SEQ ID NO: 562855 - DNA, 487 bp, Homo sapiens
  misc_feature: HIJSMM301EVJRH.47.46.E02.1.454.light.4.raw
agctcacgtacacgaccggtgctcgatttagactcatctacagggaaaggggaggaactgctcagttaggacccagacggaaccatggaagccccagcgcagcttctcttcctcctgctactctggctcccagagaccactggagaaatagtgatgacgcagtctccagccaccctgtctgtctctccaggggaaagagccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctgaagattttgctagtttattactgtcagcagtatcataactggccgctccaccttcggaccaagggacacgactggagattaaacgaactgtggctgcaccat

SEQ ID NO: 562856 - DNA, 417 bp, Homo sapiens
  misc_feature: HIJSMM301BGEHM.18.78.H01.1.454.light.4.raw
tacgagtatgcacgaccggtgctcgatttagtgtgagtagtttgggtttgggggctttgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatataccaagcagcagcactcaagtcttcggaactgggaccaaggtcaccgtcctaggtcagcccaaggccaaccccactgtcactctgttcccgccctcctccatactcgta

SEQ ID NO: 562857 - DNA, 487 bp, Homo sapiens; identical to SEQ ID NO: 536206
  misc_feature: HIJSMM301DQMQ8.47.38.D05.1.454.light.4.raw

SEQ ID NO: 562858 - DNA, 489 bp, Homo sapiens
  misc_feature: HIJSMM301A3KDM.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacaggatttcactctcaccatcagcagcctgcaggctgaagatgtggcagttattattgtcaacaatattattatacttcgtggacgttcggccaagggaccgaaggtggaagtatcagacgaa

SEQ ID NO: 562859 - DNA, 507 bp, Homo sapiens
  misc_feature: HIJSMM301AN7JO.47.85.H08.1.454.light.4.raw
agctcacgtacacgaccggtgctcgatttagtatcactcagtcgcgggggctggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctgacaacacggcctccctgaccatctctgggctcgagtctgaggacgaggctgattacttctgttgctcttgggcaactactgtcgtttgggtgttcggcggagggaccaagttgaccgtcctaggtcagcccaaggctgccccctcggtcact

SEQ ID NO: 562860 - DNA, 488 bp, Homo sapiens
  misc_feature: HIJSMM301BMLPC.26.45.E01.1.454.light.4.raw
agactatactcacgaccggtgctcgatttagtgagtcagtaagggaaaggggtgatcaggactcctcagttcaccttctcacaatgaggctccctgctcagctcctggggctgctaatgctctgggtctctggatccagtggagatattgtgatggctcagtctccactctccctgcccgtcacccctggagagccggcctccatctcctgcaggtctagtcagagcgtcctgcatagtagtggatacaactatttggattggtacctgcagaagccagggcagtctccacagctcctgatctatttggcttctaatcgggcctccggggtccctgacaggttcagtggcagtggatcagacacagattttacactgaaaatcagtagagtggaggctgaggatgttggagtttattactgcatgcaagctctacaaactcctctcactttcggcggagggaccaaggtggagatacaaacgaactgt

SEQ ID NO: 562861 - DNA, 498 bp, Homo sapiens
  misc_feature: HIJSMM301DMISU.9.39.D06.1.454.light.4.raw
tgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaagagccaccctctcctgcagggccagtcagagtgttagtagtaggttagcctggcaccagcaaaaacctggccagcctcccaggctcctcatctatgatgcatccaccaggaccactggtgtcccagccaggttcagtgggagtgggtctggggacagagttcactctcaccatcagcagtctgcagtcggaagattttgcagtttactattgtcagcagtatagtaacgggccgctcactttcggcggagggaccaaggtggagatcaaacgaactgtggctgcaccatctgtcttcta

SEQ ID NO: 562862 - DNA, 503 bp, Homo sapiens
  misc_feature: HIJSMM301B2QID.9.53.E09.1.454.light.4.raw
tgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggctccctgacaatctctgggctccaggctgaggacgaggctgattattactgctgctcatatgcagatggtgacactcccgtggtattcggcggagggaccaaggtgaccgtcctaggtcagcccaaggctgtccccccg

SEQ ID NO: 562863 - DNA, 502 bp, Homo sapiens
  misc_feature: HIJSMM301BKRI4.40.42.D09.1.454.light.4.raw
tctagcgactcacgaccggtgctcgatttagacacatacgcagggaaagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagaagcattgccaaaaaaatatgcttattggtaccaacagaagtcaggccaggcccctgtgctggtcatctatgaggacaacaaacgaccctccgagatccctgagagattctctggctccagctcagggacaatggccaccttggctctcagtggggcccaggtggaggatgaagctgactactactgttactcagtggacagcagtggaaatcatggggtattcggcggagggaccaagctgaccgtcctaggtcagcccaaggctgccccctcggtcactctcg

SEQ ID NO: 562864 - DNA, 486 bp, Homo sapiens; identical to SEQ ID NO: 535043
  misc_feature: HIJSMM301EHU03.46.35.D02.1.454.light.4.raw

SEQ ID NO: 562865 - DNA, 483 bp, Homo sapiens
  misc_feature: HIJSMM301BSZQQ.17.34.D01.1.454.light.4.raw
cgtagactagcacgaccggtgctcgatttagatcgtctgtgttgggtttgggtcatcacaatatctgcactggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttcctccgacgttcggccaagggaccaaggtggaactcaaacgaactgtggctgcaccatctgtctcatcttcccgccatctgactagtctacg

SEQ ID NO: 562866 - DNA, 495 bp, Homo sapiens; identical to SEQ ID NO: 536055
  misc_feature: HIJSMM301BQ5W0.47.38.D05.1.454.light.4.raw

SEQ ID NO: 562867 - DNA, 487 bp, Homo sapiens; identical to SEQ ID NO: 541583
  misc_feature: HIJSMM301BHOFO.41.57.F02.1.454.light.4.raw

SEQ ID NO: 562868 - DNA, 485 bp, Homo sapiens; identical to SEQ ID NO: 536576
  misc_feature: HIJSMM301CDK9B.46.35.D02.1.454.light.4.raw

SEQ ID NO: 562869 - DNA, 440 bp, Homo sapiens
  misc_feature: HIJSMM301A3DNA.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgcccctcggtcactctgttcccgccctcctcgtatctctcg

SEQ ID NO: 562870 - DNA, 447 bp, Homo sapiens; identical to SEQ ID NO: 535020
  misc_feature: HIJSMM301CV23F.18.9.A09.1.454.light.4.raw

SEQ ID NO: 562871 - DNA, 490 bp, Homo sapiens; identical to SEQ ID NO: 535234
  misc_feature: HIJSMM301BSNDC.17.21.B10.1.454.light.4.raw

SEQ ID NO: 562872 - DNA, 496 bp, Homo sapiens; identical to SEQ ID NO: 542070
  misc_feature: HIJSMM301DNCAZ.22.14.B03.1.454.light.4.raw

SEQ ID NO: 562873 - DNA, 507 bp, Homo sapiens
  misc_feature: HIJSMM301AZS43.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggctccctgaccatctctgggctcgagtctgaggacgaggctgattacttctgttgctcttgggcaactactgtcgtttggtgttcggcggagggaccaagttgaccgtcctaggtcagcccaaggctgccccctcggtcactctgtt

SEQ ID NO: 562874 - DNA, 503 bp, Homo sapiens; identical to SEQ ID NO: 535140
  misc_feature: HIJSMM301D8WIJ.18.37.D04.1.454.light.4.raw

SEQ ID NO: 562875 - DNA, 481 bp, Homo sapiens
  misc_feature: HIJSMM301AGG3Q.22.59.F04.1.454.light.4.raw
acatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgttagcagcagcttagcctggtaccagcagaaacctggccaggctcccaggctcctcatctatggtgcatctacgagggccactggtatcccagccaggttcagtggcagtgggtctgggacagagttcactctcaccatcagcagcctgcagtctgaagattttgcagtttattactgtcagcactataataactggcctccgtacagttttggccaggggaccaagctggagatacaaacgaa

SEQ ID NO: 562876 - DNA, 487 bp, Homo sapiens; identical to SEQ ID NO: 554752
  misc_feature: HIJSMM301B7LEY.3.12.B01.1.454.light.4.raw

SEQ ID NO: 562877 - DNA, 454 bp, Homo sapiens; identical to SEQ ID NO: 534964
  misc_feature: HIJSMM301D7KM1.19.86.H09.1.454.light.4.raw

SEQ ID NO: 562878 - DNA, 479 bp, Homo sapiens
  misc_feature: HIJSMM301DL84N.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacacctgcgtggttttggctgtcggcggcgggacc

SEQ ID NO: 562879 - DNA, 383 bp, Homo sapiens; identical to SEQ ID NO: 447524
  misc_feature: HIJSMM301ALKH6.41.26.C04.1.454.light.4.raw

SEQ ID NO: 562880 - DNA, 487 bp, Homo sapiens
  misc_feature: HIJSMM301EZD9U.47.78.H01.1.454.light.4.raw
  modified_base (469)..(469): a, c, t, g, unknown or other
agctcacgtacacgaccggtgctcgatttagtgtgagtagtttgggtttgggaacctatgaacattctgtaggggccactgtcttctccacggtgctcccttcatgcgtgactcagccaccctcagcgtctgggacccccgggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcagcctccctggccatcagtgggctccggtccgaggatgaggctgattattattgtgcaacatgggatagtagcctgagtagtgtggttttcggcggagggaccaaaactgaccgtcctaggtcagcccaaggctgccccctcggtccactctgttcccnccctcctctacgtgagct

SEQ ID NO: 562881 - DNA, 509 bp, Homo sapiens; identical to SEQ ID NO: 541829
  misc_feature: HIJSMM301ES6OO.17.28.C06.1.454.light.4.raw

SEQ ID NO: 562882 - DNA, 491 bp, Homo sapiens; identical to SEQ ID NO: 536211
  misc_feature: HIJSMM301EM1QG.16.53.E09.1.454.light.4.raw

SEQ ID NO: 562883 - DNA, 490 bp, Homo sapiens; identical to SEQ ID NO: 550493
  misc_feature: HIJSMM301BE9WB.10.59.F04.1.454.light.4.raw

SEQ ID NO: 562884 - DNA, 497 bp, Homo sapiens; identical to SEQ ID NO: 535740
  misc_feature: HIJSMM301AD3HE.3.71.G05.1.454.light.4.raw

SEQ ID NO: 562885 - DNA, 486 bp, Homo sapiens
  misc_feature: HIJSMM301EQOXM.14.68.G02.1.454.light.4.raw
cgtctagtaccacgaccggtgctcgatttagtcgatagtgaagggaaagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacatcaggaaatatttaaattggtatcagcagaaaccagggaaagcccctaaactcctgatcttcgatgcatccaatttggaaacaggggtcccatcaaggttcagggaagtggatctgggacagattttagtttcaccatcagcagcctgcagcctgaagatattggaacatattactgtcaacagtatgataatttaccgctcactttcggcggagggaccaaggtggacatcaaacgaactgtggctgcaccat

SEQ ID NO: 562886 - DNA, 502 bp, Homo sapiens; identical to SEQ ID NO: 537816
  misc_feature: HIJSMM301EJHG0.19.78.H01.1.454.light.4.raw

SEQ ID NO: 562887 - DNA, 516 bp, Homo sapiens
  misc_feature: HIJSMM301DFOBD.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcgtccgacgggaccgaacggtaggaaagtacaagacgaacgtagtggcgtcgcaccactctgtcttctactcttcccgt

SEQ ID NO: 562888 - DNA, 491 bp, Homo sapiens; identical to SEQ ID NO: 536988
  misc_feature: HIJSMM301DFFRP.17.21.B10.1.454.light.4.raw

SEQ ID NO: 562889 - DNA, 469 bp, Homo sapiens; identical to SEQ ID NO: 536091
  misc_feature: HIJSMM301CANBH.3.82.H05.1.454.light.4.raw

SEQ ID NO: 562890 - DNA, 497 bp, Homo sapiens; identical to SEQ ID NO: 536376
  misc_feature: HIJSMM301A48WT.22.9.A09.1.454.light.4.raw

SEQ ID NO: 562891 - DNA, 488 bp, Homo sapiens; identical to SEQ ID NO: 551150
  misc_feature: HIJSMM301A76LN.13.87.H10.1.454.light.4.raw

SEQ ID NO: 562892 - DNA, 462 bp, Homo sapiens; identical to SEQ ID NO: 559067
  misc_feature: HIJSMM301A6QXG.15.11.A11.1.454.light.4.raw

SEQ ID NO: 562893 - DNA, 493 bp, Homo sapiens; identical to SEQ ID NO: 552001
  misc_feature: HIJSMM301DT5DN.51.45.E01.1.454.light.4.raw

SEQ ID NO: 562894 - DNA, 511 bp, Homo sapiens
  misc_feature: HIJSMM301B8YB4.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgtcgtccacgggaccgacacgtagaaatagagacgaactacgtggcgtgcaccactctcgtcttctactcttcccgt

SEQ ID NO: 562895 - DNA, 496 bp, Homo sapiens; identical to SEQ ID NO: 537925
  misc_feature: HIJSMM301DHKT9.22.14.B03.1.454.light.4.raw

SEQ ID NO: 562896 - DNA, 489 bp, Homo sapiens; identical to SEQ ID NO: 535386
  misc_feature: HIJSMM301D9EXA.12.51.E07.1.454.light.4.raw

SEQ ID NO: 562897 - DNA, 480 bp, Homo sapiens
  misc_feature: HIJSMM301BMBJ4.5.39.D06.1.454.light.4.raw
atcagacacgcacgaccggtgctcgatttagtgacatctcgcagttctttggggaggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccaggagaggccccaaagctccttatttatgatgcctccactttgattagtggggtcccaccaacgttcagcggcagtggatctgggacagagttcactctcaccatcagcagcctgcagcctgatgatcttggaacttattactgccaacaatataatagttattggacgttcggccagggaccaaggtcgaatgagacgaactgtggctgcacc

SEQ ID NO: 562898 - DNA, 494 bp, Homo sapiens; identical to SEQ ID NO: 534992
  misc_feature: HIJSMM301ETIS9.9.1.A01.1.454.light.4.raw

SEQ ID NO: 562899 - DNA, 513 bp, Homo sapiens
  misc_feature: HIJSMM301AOYHN.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggaggaccaagttgaccgtcctaggtcagcccaaggctgccccctcggtcactctgttccccg

SEQ ID NO: 562900 - DNA, 487 bp, Homo sapiens
  misc_feature: HIJSMM301BZWZQ.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaaacgaaactgtggctgcaccat

SEQ ID NO: 562901 - DNA, 493 bp, Homo sapiens; identical to SEQ ID NO: 535047
  misc_feature: HIJSMM301AP800.16.53.E09.1.454.light.4.raw

SEQ ID NO: 562902 - DNA, 505 bp, Homo sapiens
  misc_feature: HIJSMM301BFS9D.10.88.H11.1.454.light.4.raw
catagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtcttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcagtgggtctgggacagacttcactctcaccatcagcagcctggagcctgaagatattgcagtttattattgtcagcagcgtagcaggtggcctttcactttcggcccggggaccaaagtggaaatcaaacgaactgtggctgcaccatctgtcttcatcttcccgc

SEQ ID NO: 562903 - DNA, 495 bp, Homo sapiens; identical to SEQ ID NO: 549227
  misc_feature: HIJSMM301BW5YY.22.27.C05.1.454.light.4.raw

SEQ ID NO: 562904 - DNA, 476 bp, Homo sapiens; identical to SEQ ID NO: 538611
  misc_feature: HIJSMM301EAMML.7.81.H04.1.454.light.4.raw

SEQ ID NO: 562905 - DNA, 469 bp, Homo sapiens
  misc_feature: HIJSMM301B7VU5.4.76.G10.1.454.light.4.raw
agcactgtagcacgaccggtgctcgatttagtcactcatacaggggggagtcagactcagtcaggacacagcatggacatgagggtccccgctcagctcctggggctcctgctgctctggctcccaggtgccaaatgtgacatccagctgacccagtctccctccaccctgtctgcatctataggagacagagtcaccatcacttgccgggccagtcagagtattagtaactggttggcctggtatcagcagaaaccaggcaaagccccaaagctccttatctctgatgcctccactttgcacggtggcgtcccaccaacgttcagcggcagtggatctgggacagaattcactctcaccatcagcagcctgcagcctgatgatgttgcaacttattactgtcaacaatataacaattattgacgttcgccaaggaccaaggtggaaatcaaacgaactgtggctgcac

SEQ ID NO: 562906 - DNA, 472 bp, Homo sapiens; identical to SEQ ID NO: 536302
  misc_feature: HIJSMM301CLXZ0.18.76.G10.1.454.light.4.raw

SEQ ID NO: 562907 - DNA, 499 bp, Homo sapiens
  misc_feature: HIJSMM301CW6UY.3.72.G06.1.454.light.4.raw
agacgcactccacgaccggtgctcgatttagctacgactgcaagggaaaggggaggaactgctcagttaggacccagagggaaccatggaagccccagctcagcttctcttcctcctgctactctggctcccagatacaaccggagaaattgtgttgacacagtctccagccaccctgtctttgtctccaggggaaagagccactctctcctgcagggccagtcagagtgttagcagctacttagcctggtaccagcagaaacctggccaggctcccaggctcctcatttatgatgcatccaacagggccactggcatcccagccaggttcagtggcagtgggtctgggacagacttcactctcaccatcagcagcctagagcctgaagattttgcagtttattactgtcagcagcgtagcaactggcctctcaccttcggcggagggaccgaaggtggaggatacaaacgaaactggtggcgtcgcacccaatctgtt

SEQ ID NO: 562908 - DNA, 509 bp, Homo sapiens
  misc_feature: HIJSMM301COKNQ.51.86.H09.1.454.light.4.raw
cgatcgtatacacgaccggtgctcgatttagtgctatagacttgggttgggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggtttcagcagaggccaggccaatctccaagacgcctaatttataaggtttctaaccgggactctggggtcccagacagattcagcggcagtgggtcaggcactgatttcacactgataatcgacagggtggaggctgaggatgttgggttttattactgcatgcaaggtacacactggcctgggacgttcggccaagggaccaaggtggaaatacaaacgaactgtggctgcaccatctgtctt

SEQ ID NO: 562909 - DNA, 506 bp, Homo sapiens; identical to SEQ ID NO: 551204
  misc_feature: HIJSMM301C5SUZ.15.59.F04.1.454.light.4.raw

SEQ ID NO: 562910 - DNA, 517 bp, Homo sapiens
  misc_feature: HIJSMM301BBD6P.41.25.C03.1.454.light.4.raw
tctatactatcacgaccggtgctcgatttagtagtgtagatttgggtttgggggatagctcaggaagcagagcctggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctggggtcccctttcggtttctggctccatcgacagtccctccaactccgcctcccttaccatatctgggctgaagagtgaggacgaggctgactacttctgtcagtcttatgatataaacaattatgtgataattggcggagggaccagggtgaccgtcctaggtcagcccaaggctgccccctcggtcactctgttccca

SEQ ID NO: 562911 - DNA, 487 bp, Homo sapiens; identical to SEQ ID NO: 561279
  misc_feature: HIJSMM301A5FUW.19.71.G05.1.454.light.4.raw

SEQ ID NO: 562912 - DNA, 504 bp, Homo sapiens
  misc_feature: HIJSMM301BF7VH.4.71.G05.1.454.light.4.raw
agcactgtagcacgaccggtgctcgatttagtgtcgtcgcaagagagaggggggcgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataatttctgggtgttcggcggagggaccaaactgaccgtcctaggtcagccaaggctgccccctcggtcactctgtt

SEQ ID NO: 562913 - DNA, 504 bp, Homo sapiens; identical to SEQ ID NO: 561069
  misc_feature: HIJSMM301CSQV6.19.78.H01.1.454.light.4.raw

SEQ ID NO: 562914 - DNA, 498 bp, Homo sapiens
  misc_feature: HIJSMM301AP73P.22.38.D05.1.454.light.4.raw
acatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccgggggaaagagccaccctctcctgcagggccagtcagaatgttagtagttacttagcctggtaccagcaaaagcctggccaggctcccagactcctcatctctgatacatccaacagggccactggcatcccagccaggttcagtggcagtgggtctgggacagacttcactctcaccatcagcgacctagagcctgaagattttgcagtttattactgtcagcagcgtagcatctggcctccgtacacctttggccaggggaccaagctggagatcaaacgaactgtggctgcacatctgtcttcat

SEQ ID NO: 562915 - DNA, 489 bp, Homo sapiens; identical to SEQ ID NO: 558034
  misc_feature: HIJSMM301ASYJA.8.12.B01.1.454.light.4.raw

SEQ ID NO: 562916 - DNA, 485 bp, Homo sapiens; identical to SEQ ID NO: 536723
  misc_feature: HIJSMM301C8X0U.5.40.D07.1.454.light.4.raw

SEQ ID NO: 562917 - DNA, 513 bp, Homo sapiens
  misc_feature: HIJSMM301ANDFV.10.75.G09.1.454.light.4.raw
catagtagtgcacgaccggtgctcgatttagtatagacatcaggggggggtctcaggaggcagcgctctcgggacgtctccaccatggcctgggctctgctattcctcaccctcctcactcagggcacaggttcctgggcccagtctgccctgtctcagcctgcctccgtgtctgggtctcctggacagtcgatcaccatctcctgcaatggaagcgaaagtgacattggttctttaaattttgtctcttggtaccaacagagcccagacaaagcccccaaaattatcatttctgctgtcagtaatcggccctcaggggtttctagtcgcttctctggctccaagtctggcaacacggcctccctgaccatctctgggctccaggctgaggacgaggctgattattattgcagctcatatacaaacaccaaagctttgatattcggcggagggaccaaactgaccgtcctcgttcagcccaaggctgccccctccggtcactctcgttcccgt

SEQ ID NO: 562918 - DNA, 467 bp, Homo sapiens; identical to SEQ ID NO: 535997
  misc_feature: HIJSMM301CU4IX.5.36.D03.1.454.light.4.raw

SEQ ID NO: 562919 - DNA, 510 bp, Homo sapiens
  misc_feature: HIJSMM301AO6UC.47.55.E11.1.454.light.4.raw
agctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctaggtcagcccaaggccaacccccac

SEQ ID NO: 562920 - DNA, 480 bp, Homo sapiens
  misc_feature: HIJSMM301BXHVR.10.1.A01.1.454.light.4.raw
catagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagctcctctccgacaggaataacatccggccctcagggatctcagagagattctctgcatccaggtcaggaagcacagcctctctgaccattactggactccaggctgacgacgaagctgattattactgctcagcatgggacaccggcctcagtgcgtgggttttcggcggagggaccaagctgaccgtcctaggtcacg

SEQ ID NO: 562921 - DNA, 486 bp, Homo sapiens; identical to SEQ ID NO: 536323
  misc_feature: HIJSMM301DI4UF.10.2.A02.1.454.light.4.raw

SEQ ID NO: 562922 - DNA, 519 bp, Homo sapiens
  misc_feature: HIJSMM301ENVWP.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgccgaacggaccgaacggtaggaaggtacgaaacgaactacgtggcgtgcgaccactctgtcttctactcttcccgtcccact

SEQ ID NO: 562923 - DNA, 515 bp, Homo sapiens; identical to SEQ ID NO: 539211
  misc_feature: HIJSMM301CVIM3.22.28.C06.1.454.light.4.raw

SEQ ID NO: 562924 - DNA, 484 bp, Homo sapiens; identical to SEQ ID NO: 538770
  misc_feature: HIJSMM301C0274.4.57.F02.1.454.light.4.raw

SEQ ID NO: 562925 - DNA, 497 bp, Homo sapiens
  misc_feature: HIJSMM301D1IUD.22.14.B03.1.454.light.4.raw
  modified_base (124)..(124): a, c, t, g, unknown or other
acatacgcgtcacgaccggtgctcgatttagtgtgagtagttccgcgggggagctacaacaggcaggcaggggcagcaagatggtgttgcagacccaggtcttcatttctctgttgctctgganctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcggccaagggaccaaggtggaaatcaaacgaactgtggctgcacca

SEQ ID NO: 562926 - DNA, 488 bp, Homo sapiens
  misc_feature: HIJSMM301EKODT.13.46.E02.1.454.light.4.raw
tcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatcagcagggtggaggctgaggatgttattgggctctattattgcatgcaagcaacacactggccgtacacttttggccaggggaccaagctggagatcaatcgaact

SEQ ID NO: 562927 - DNA, 495 bp, Homo sapiens; identical to SEQ ID NO: 535964
  misc_feature: HIJSMM301BPSCF.16.10.A10.1.454.light.4.raw

SEQ ID NO: 562928 - DNA, 507 bp, Homo sapiens
  misc_feature: HIJSMM301ALXG1.11.75.G09.1.454.light.4.raw
cgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccggttatggtatgctctggtatcaacaacgtccaggaatggcccccaaactcctcatctatgctgacaacaatcgaccttcaggggtccctgaccggttctctggctccaagtctggctcttccgcctccttggccatcactgggctcgaggctgacgatgaggctgattactactgtctgtcctatgacgacgacctacagactccggttttcggcggagggactaagctgaccgtcctaagtcagcccaaggctgccccctcggtcactcctgttcccg

SEQ ID NO: 562929 - DNA, 491 bp, Homo sapiens
  misc_feature: HIJSMM301CAGSC.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcaggtggaggctgaggatgtcggggtttactactgcatgcagggtacactctggccgttcacttttggccaggggaccaaactggataatcagacgaactgtggctgcaa

SEQ ID NO: 562930 - DNA, 488 bp, Homo sapiens; identical to SEQ ID NO: 537260
  misc_feature: HIJSMM301EJOVB.47.70.G04.1.454.light.4.raw

SEQ ID NO: 562931 - DNA, 500 bp, Homo sapiens
  misc_feature: HIJSMM301C1VTK.22.27.C05.1.454.light.4.raw
acatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttattactgtcagcaatattatattcctccttcagacgttcggccaagggaccaaggtggaaatcaaacgaactgtggctgcacca

SEQ ID NO: 562932 - DNA, 512 bp, Homo sapiens
  misc_feature: HIJSMM301C33XS.43.19.B08.1.454.light.4.raw
tgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatccggtcttcggcggagggaccaagttgaccgtcctaagtcagcccaaggctgccccctggtccactctgttcccgccctcctca

SEQ ID NO: 562933 - DNA, 498 bp, Homo sapiens; identical to SEQ ID NO: 537020
  misc_feature: HIJSMM301CMOVP.26.26.C04.1.454.light.4.raw

SEQ ID NO: 562934 - DNA, 504 bp, Homo sapiens
  misc_feature: HIJSMM301EGD52.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcggccaagggaccaaggtggaaatcaaacgaactgtggctgcaccatctgtcttctatcttccccg

SEQ ID NO: 562935 - DNA, 510 bp, Homo sapiens; identical to SEQ ID NO: 551695
  misc_feature: HIJSMM301BYG51.13.36.D03.1.454.light.4.raw

SEQ ID NO: 562936 - DNA, 494 bp, Homo sapiens
  misc_feature: HIJSMM301DVG7J.10.60.F05.1.454.light.4.raw
catagtagtgcacgaccggtgctcgatttagtacgtcatcagggaaaggggggggtctcaggaggcagcactctcgggacgtctccaccatggcctgggctctgctcctcctcagcctcctcactcagggcacaggatcttgggctcagtctgccctgactcagcctcgctcagtgtccgggtctcctggacagtcagttaccatctcctgcactggaacctccaatgatgttggtggttatatctatgtctcctggtaccaacaacacgcaggcaaagcccccgaagtcatgatttatgatgtcagtaagcggccctcaggggtccctgaccgcttctctggctccaagtctggcaacacggcctccctgaccatctctggcctccaggctgaggatgaggctgactattattgctgctcatatgcaggcggacctggttccggtatgtcttcggaactgggaccacggtcaccgtcctaggtcagcccaagg

SEQ ID NO: 562937 - DNA, 499 bp, Homo sapiens
  misc_feature: HIJSMM301AXDXS.52.36.D03.1.454.light.4.raw
cgcagtacgacacgaccggtgctcgatttagctgcgtcacgatctctcttgggggtgggctcaggaggcagagctgtgggtgtctcaccatggcgtgggccacactcctgctcccactcctcaacctctacgcaggctctgttgcctcctatgagctgacacagcttccctcggtgtcagtgtccccaggacagacagccaggatcacctgctctggagatgtactggggaaaaattatgctgactggtaccagcagaagccaggccaagcccctgagttggtgatatacgaaatagtgagcgctaccctgggatccctgaccgattctctgggtccacctcagggaagacgaccacctgaccatcaacagggtccggactgaagacgaggctgactattactgcttgtctggggatgaggacacattggtgttcggcgggaggacaagctgaccgtcctacgtcagcccaaggctcgccccctcggtccactctcgtt

SEQ ID NO: 562938 - DNA, 492 bp, Homo sapiens; identical to SEQ ID NO: 536010
  misc_feature: HIJSMM301BLIX5.10.20.B09.1.454.light.4.raw

SEQ ID NO: 562939 - DNA, 514 bp, Homo sapiens
  misc_feature: HIJSMM301ELPPI.16.1.A01.1.454.light.4.raw
tgtactactccacgaccggtgctcgatttagacgtctcatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtgtttcggcggagggaccaagctgaccgtcctaggtcagcccaaggctcgccccctcggtcactctcgttccccg

SEQ ID NO: 562940 - DNA, 514 bp, Homo sapiens; identical to SEQ ID NO: 546238
  misc_feature: HIJSMM301EKDYC.47.85.H08.1.454.light.4.raw

SEQ ID NO: 562941 - DNA, 485 bp, Homo sapiens; identical to SEQ ID NO: 540394
  misc_feature: HIJSMM301EKYTD.46.26.C04.1.454.light.4.raw

SEQ ID NO: 562942 - DNA, 376 bp, Homo sapiens
  misc_feature: HIJSMM301AGDU4.40.9.A09.1.454.light.4.raw
tctagcgactcacgaccggtgctcgatttagcgagacgcgcagggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctctttactgggcgtcttcccgggagtccggggtccctgaccgattcagtgccagcgggtctgggacagacttcactctcacca

SEQ ID NO: 562943 - DNA, 494 bp, Homo sapiens
  misc_feature: HIJSMM301DWY98.43.29.C07.1.454.light.4.raw
tgtgagtagtcacgaccggtgctcgatttagagtgctacgaagggaaaggggggagtcagacccactcaggacacagcatggacatgagggtccccgctcagctcctggggcttctgctgctctggctcccaggtgccagatgtgccatccagttgacccagtctccatcctccctgtctgcatcagtaggagacagagtcaccatcacttgccgggcaagtcagggcattggaaccgctttagcctggtatctgcagaacccagggaaagctcctaagctcctcatctctggtgcctccactttggaaagtggggtcccatcaagattcagcggtagtggatctgggacagaattcactctcaccgtcagcagcctgcagcctgaagattttgcaacttattactgtcaacagtttaataactaccctctcactttcggaggagggaccagggtggagatcaaacgaactgtggctgcaccatctgtcttcta

SEQ ID NO: 562944 - DNA, 444 bp, Homo sapiens; identical to SEQ ID NO: 535411
  misc_feature: HIJSMM301DULZB.8.73.G07.1.454.light.4.raw

SEQ ID NO: 562945 - DNA, 493 bp, Homo sapiens
  misc_feature: HIJSMM301BRIBE.3.36.D03.1.454.light.4.raw
agacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccaggggagagagccaccctctcctgcggggccagtcagagtgttcccagcaactatatagcctggtaccagcacaaagttggcctggcgcccaggctcctcatctatgatacattcaccagggccactggcatcccggacaggttcagaggcagtgggtatgggacagacttcactctcaccatcagcagactggagcctggagattttgcagtttattactgtcagcagtatggtacttcacaaaccttcggccaggggacacgactggagattaagcgaactgtggctgcacatctgtctt

SEQ ID NO: 562946 - DNA, 501 bp, Homo sapiens
  misc_feature: HIJSMM301B2VKZ.43.15.B04.1.454.light.4.raw
tgtgagtagtcacgaccggtgctcgatttagacagtatatatccgcgggggggtcagagctctggggaggaactgctcagttaggacccagacggaaccatggaagccccagcgcagcttctcttcctcctgctactctggctcccagaaaccactggagaaatagtgatgacgcagtctccagccaccctgtctttgtctccaggggaaagagccaccctctcatgcagggccagtcagagtgttagcaccaacgtggcctggtaccagcagaaacctggccagcctccccggctcctcatctctggtgcatcctccagggccactggttccccagccaggttcagtggcagtgggtctgggacagagttcactctcaccatcagcagccttcagtctgaagattttgcagtttattactgtcaccagtatcataactggcctccaagggggactttcggccaggaccaaggtggaatcaacgaactgtggctgcaccat

SEQ ID NO: 562947 - DNA, 484 bp, Homo sapiens
  misc_feature: HIJSMM301EY7QD.7.83.H06.1.454.light.4.raw
cgtgtctctacacgaccggtgctcgatttagatcacgtgcgtcgcggggctccaaacagagcttcagcaagcatagtgggaatctgcaccatgcccggggctctgctcctcctgaccctcctcactcactctgcagtgtcagtggtccaggcagggctgactcagccgccctcggtgtccaagggcttggggcagaccgccacactcacctgcactgggaacagcaacaatgttggcgaccaaggagcagcttggctgcagcagcaccagggccaccctcccaaactcctatcctacaggaataacaaccggccctcagggatctcggagagattctctgtatccaggtcaggatacacagcctccctgaccattactggactccagcctgaggacgaggctgactattactgctcagcatgggacagcagcctccgtggtgtggtgatcggcggagggaccaggctgaccgtcctaggtcacg

SEQ ID NO: 562948 - DNA, 508 bp, Homo sapiens; identical to SEQ ID NO: 552623
  misc_feature: HIJSMM301BA989.17.33.C11.1.454.light.4.raw

SEQ ID NO: 562949 - DNA, 496 bp, Homo sapiens
  misc_feature: HIJSMM301DQY56.13.5.A05.1.454.light.4.raw
  modified_base (402)..(402): a, c, t, g, unknown or other
tcacgtactacacgaccggtgctcgatttagatagatagacagggggaggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtcctgaccgattcagtggcaggcgggtctggggacagtatttcactctcaccatcagcagcctgcaggctgaagntgtggctagtttatactgtcagctaatattatagtactcctccgaggctcactttcggcggagggaccaaggtggagatacaaacgaactgtgg

SEQ ID NO: 562950 - DNA, 477 bp, Homo sapiens
  misc_feature: HIJSMM301EYBMZ.48.40.D07.1.454.light.4.raw
agtatacatacacgaccggtgctcgatttagtgatagagcgtaacaacagaggggactgatcaggactcctcagttcaccttctcacaatgaggctccctgctcagctcctggggctgctaatgctctgggtctctggatccagtggggaaattgtgatgactcagtctccactctccctgcccgtcacccctggagagccggcctccatctcctgcaggtctagtcagagtctcctgcatagtaatggatacaattatttggattggtatttgcagaagccagggcagtctccacagctcctgatctatttgggttctaatcgggcctccggggtccctgacaggttcagtggccatggatcaggcacagatttcacactgaaaatcagcagagtggaggctgaggatgttggagtttactactgcatgcaagctctgcatactgctcggacgtcgtccaaggacgaacggtggag

SEQ ID NO: 562951 - DNA, 480 bp, Homo sapiens; identical to SEQ ID NO: 535442
  misc_feature: HIJSMM301EDWBE.41.17.B06.1.454.light.4.raw

SEQ ID NO: 562952 - DNA, 484 bp, Homo sapiens; identical to SEQ ID NO: 538157
  misc_feature: HIJSMM301EOEJI.26.70.G04.1.454.light.4.raw

SEQ ID NO: 562953 - DNA, 500 bp, Homo sapiens
  misc_feature: HIJSMM301CHFUM.41.55.E11.1.454.light.4.raw
tctatactatcacgaccggtgctcgatttagcactcgcacgttgggtttggggctgggcctaaggaagcagcactggtggtgcctcagccatggcctggaccgttctcctcctcggcctcctctctcactgcacagcctctgtgacctcctatgtgttgactcagccaccctcggcgtcagtggccctaggacagacggccaggattacctgtggggcaaataagataggaactacaaatgtgcactggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccaagctgaccgtcctaggtcagcccaaggctgccccctcggtcact

SEQ ID NO: 562954 - DNA, 491 bp, Homo sapiens
  misc_feature: HIJSMM301DJVZJ.3.79.H02.1.454.light.4.raw
agacgcactccacgaccggtgctcgatttagtgtcacacgaagggaaaggggggggtcgtcaggaggcagcgctctcgggacgtctccaccatggcctgggctctgctattcctcaccctcctcactcagggcacagagtcctgggcccagtctgccctgactcagcctgcctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctg

SEQ ID NO: 562955 - DNA, 473 bp, Homo sapiens
  misc_feature: HIJSMM301D6CB6.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctcctccgagtgcctacttttggcggggggaccaaggtggacatcaaacgaa

SEQ ID NO: 562956 - DNA, 479 bp, Homo sapiens
  misc_feature: HIJSMM301D4WDS.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgtccctccctccctcctctactacgtctacgtagcgggcggtcgtcgacggacggcg

SEQ ID NO: 562957 - DNA, 484 bp, Homo sapiens; identical to SEQ ID NO: 535400
  misc_feature: HIJSMM301BB5XP.46.26.C04.1.454.light.4.raw

SEQ ID NO: 562958 - DNA, 491 bp, Homo sapiens
  misc_feature: HIJSMM301BB3EG.40.81.H04.1.454.light.4.raw
tctagcgactcacgaccggtgctcgatttagtagtgtagattcgcgggtgatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggcctccggggtccctgacaggttcagtggcagtggatcagtcacagattttacactagaaaatcagcagggtggaggcagaagatgttgggatttattactgcatgcaacctctacaaactgtgtggacggtcggccaagggaccaaggtggaaatcaagcgaactgtggctgca

SEQ ID NO: 562959 - DNA, 493 bp, Homo sapiens; identical to SEQ ID NO: 549574
  misc_feature: HIJSMM301C4K27.16.53.E09.1.454.light.4.raw

SEQ ID NO: 562960 - DNA, 498 bp, Homo sapiens
  misc_feature: HIJSMM301BYABF.52.78.H01.1.454.light.4.raw
cgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctcctcctcagggacaacagtcacgttgatcatcagtggagtccgggcagaggacgaggctgactattactgtcaatcaacagacagtaagtggtactatgtgcagttcggcggagggaccaagctgaccgtcctaggtcagcccaaggctgccccctcggt

SEQ ID NO: 562961 - DNA, 483 bp, Homo sapiens
  misc_feature: HIJSMM301DI0AO.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaactttggccagggaccaagctggagatcaaacgaactgtgctgcaccat

SEQ ID NO: 562962 - DNA, 486 bp, Homo sapiens; identical to SEQ ID NO: 540808
  misc_feature: HIJSMM301AL32O.26.70.G04.1.454.light.4.raw

SEQ ID NO: 562963 - DNA, 495 bp, Homo sapiens
  misc_feature: HIJSMM301AXJFV.12.23.C01.1.454.light.4.raw
atacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaagagccaccctctcctgcagggccagtcagagtgttaatagcgacttagcctggtaccagcagatacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcagcagtataataactggttcctgctcactttcggcgggggaccgaaggtggagatcaaacgaactagtggctgcaccatctgtt

SEQ ID NO: 562964 - DNA, 497 bp, Homo sapiens
  misc_feature: HIJSMM301B44Z1.52.36.D03.1.454.light.4.raw
cgcagtacgacacgaccggtgctcgatttagctgcgtcacgatctctcttgggggtgggctcaggaggcagagctgtgggtgtctcaccatggcgtgggccacactcctgctcccactcctcaacctctacgcaggctctgttgcctcctatgagctgacacagcttccctcggtgtcagtgtccccaggacagacagccaggatcacctgctctggagatgtactggggaaaattatgctgactggtaccagcagaagccaggccaagcccctgagttggtgatatacgaaatagtgagcgctaccctgggatccctgaccgattctctgggtccacctcagggaagacgaccaccctgaccatcaacagggtccggactgaagacgaggctgactattactgcttgtctggggatgaggacacattggtgttcggcggagggaccaagctgaccgtcctacgtcagcccaaggctgccccctcggtcactctgtt

SEQ ID NO: 562965 - DNA, 519 bp, Homo sapiens
  misc_feature: HIJSMM301D7AFP.41.19.B08.1.454.light.4.raw
tctatactatcacgaccggtgctcgatttagtgagtcagtaaggggtggggtctcaggaggcagcgctctcgggacgtctccaccatggcctgggctctgctatccctcaccctcctcactcagggcacagggtcctggccccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaaccccactgtcactctgttcccgccctcctc

SEQ ID NO: 562966 - DNA, 479 bp, Homo sapiens; identical to SEQ ID NO: 540569
  misc_feature: HIJSMM301D31BB.5.70.G04.1.454.light.4.raw

SEQ ID NO: 562967 - DNA, 477 bp, Homo sapiens; identical to SEQ ID NO: 537453
  misc_feature: HIJSMM301AZ88P.8.85.H08.1.454.light.4.raw

SEQ ID NO: 562968 - DNA, 495 bp, Homo sapiens
  misc_feature: HIJSMM301ELHGY.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccctcggtcactctgttcccgccctcctgagtgcgtct

SEQ ID NO: 562969 - DNA, 445 bp, Homo sapiens
  misc_feature: HIJSMM301CNADM.2.76.G10.1.454.light.4.raw
acgctcgacacacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaacggcccccaaactcctcatctataccaatgatgtgcggccctcaggggtccctgaccgattctctgcctccaagtctggcacgtcagccttcctggacatccgtggccttcagtctgcggatgaggctgtttatttctgttcagcacgggatgccagccggaatggcaattgggtattcgggcggagggaccaagttgaccgtcctaagtcagcccaaggctgccccctcggtcactctgttcccaccctcctctgtcgagcgt

SEQ ID NO: 562970 - DNA, 510 bp, Homo sapiens
  misc_feature: HIJSMM301BASSM.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataatttctgggtgttcggcggagggaccaaactgaccgtcctaggtcagcccaaggctgccccctcggtcactctgttcccccg

SEQ ID NO: 562971 - DNA, 486 bp, Homo sapiens
  misc_feature: HIJSMM301CSSUE.48.15.B04.1.454.light.4.raw
agtatacatacacgaccggtgctcgatttagacagtatatatccgcggggtgctcgatttagacagtatatatccgcgggcacgaccggtgctcgatttagctcgatatagttgggtttggggggtccaggaggcagaactctgggtgtctcaccatggcctggatccctctacttctccccctcctcattctctgcacaggctctgaggcctcctatgaactgacacagccaccctcggtgtcagtgtcccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagac

SEQ ID NO: 562972 - DNA, 489 bp, Homo sapiens
  misc_feature: HIJSMM301BQ221.51.28.C06.1.454.light.4.raw
cgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggatccctgagcgattctctggctccaactctgggaacacagccactctgaccatcagcgggacgcaggctgtggatgaggctgacttttactgtcaggcgtgggacagcgacactgccgtgttcggcgggggaccaagctgaccgtcctcggtcagcccaaggctgcccctcggt

SEQ ID NO: 562973 - DNA, 481 bp, Homo sapiens; identical to SEQ ID NO: 535993
  misc_feature: HIJSMM301DI8GF.21.25.C03.1.454.light.4.raw

SEQ ID NO: 562974 - DNA, 494 bp, Homo sapiens; identical to SEQ ID NO: 534992
  misc_feature: HIJSMM301D7XX1.9.1.A01.1.454.light.4.raw

SEQ ID NO: 562975 - DNA, 494 bp, Homo sapiens; identical to SEQ ID NO: 534994
  misc_feature: HIJSMM301DUQ3O.27.78.H01.1.454.light.4.raw

SEQ ID NO: 562976 - DNA, 515 bp, Homo sapiens
  misc_feature: HIJSMM301AR2UO.7.87.H10.1.454.light.4.raw
  modified_base (487)..(487): a, c, t, g, unknown or other
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggtccgaaggaccgaaggtaggaagtacgaaacgaactagtggcgtgcnccatctgtcttctatcttcccgtccact

SEQ ID NO: 562977 - DNA, 502 bp, Homo sapiens; identical to SEQ ID NO: 541971
  misc_feature: HIJSMM301CNYO0.4.39.D06.1.454.light.4.raw

SEQ ID NO: 562978 - DNA, 519 bp, Homo sapiens
  misc_feature: HIJSMM301CPDMJ.27.23.C01.1.454.light.4.raw
  modified_base (466)..(466): a, c, t, g, unknown or other
agcgtcgtctcacgaccggtgctcgatttagtacacgtgattagggattgggggggtctcaggaggcagcgctctcgggacgtctccaccatggcctgggctctgctattcctcaccctcctcactcagggcacagggtcctgggcccagtctgccctgactcagcctgcctccatgtctgggtctcctggacagtcgatcaccatctcctgcactggaacccgcgatgacgttggtgcttataactttatctgttggtaccgacaggacccaggcactgtccccaaactcattctttatgatgtcagtaatcggccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggcngaccgtcctaggtcagcccaaggctcgccccctccggtcactctgttccccgt

SEQ ID NO: 562979 - DNA, 505 bp, Homo sapiens
  misc_feature: HIJSMM301EPCUO.16.49.E05.1.454.light.4.raw
tgtactactccacgaccggtgctcgatttagagcgactagcaacacacaaaggggggggtcgacaagaggcagcgctctcgggacggtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttgggggttataaccttgtctcctggtaccagcagcacccagacaaagcccccaaactcatgatttatgagggcaataagcggccctcaggagtttctaatcgcttctctggctccacgtctggcaacacggcctccctgacaatctctggcctccaggctgaggacgaggctgattattactgctgctcatattcaagtcgtgtcactatgctttttggcggagggacaaggtgaccgtcctaggtcagcccaaggctgtccccccg

SEQ ID NO: 562980 - DNA, 454 bp, Homo sapiens; identical to SEQ ID NO: 534964
  misc_feature: HIJSMM301COKZB.19.86.H09.1.454.light.4.raw

SEQ ID NO: 562981 - DNA, 512 bp, Homo sapiens
  misc_feature: HIJSMM301ARY1N.49.16.B05.1.454.light.4.raw
agtcgagagacacgaccggtgctcgatttagagctcacgtaagggggtgggtccaggaggcagaactctgggtgtctcaccatggcctggatccctctacttctccccctcctcactctctgcacaggttctgaggcctcctatgagctgacacagccaccctcggtgtcagtgtccccaggacagacggccaggatcacctgttttggagatacgttacgaaaggaatatggtcattggtaccagcagaagacaggccaggcccctgtcttggtggtatataaagacagtgagaggccctcagggatccctgagcgattctctggctccagctcagggacaacagtcacgttgaccatcagtggagtccaggcagaagacgaggctgactattattgtcaatcagcagacaccggtggtacttatcgggtgttcggcggagggaccaagctgaccgtcctaggtcagcccaaggctgccccctcggtcactctgttcccaccctcctctct

SEQ ID NO: 562982 - DNA, 480 bp, Homo sapiens; identical to SEQ ID NO: 547229
  misc_feature: HIJSMM301A90BD.12.10.A10.1.454.light.4.raw

SEQ ID NO: 562983 - DNA, 496 bp, Homo sapiens
  misc_feature: HIJSMM301C65DO.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcacctaagcggccctcaggagtccctgatcgattctctggctccaagtctggcaacacggcctccctgaacatctctgggctccaggctgaggatgaggctgattattattgctgctcatatggaagtacctactcttttctcttcggaactgggaccacggtcaccgtcctaggtcagcccaaggccaacccc

SEQ ID NO: 562984 - DNA, 502 bp, Homo sapiens
  misc_feature: HIJSMM301A5TKW.21.81.H04.1.454.light.4.raw
tcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcagggtttctaatcgcttctctggctccaagtctggcaacacggcctccctgaccatctctgggctccaggctgatgacgaggctgattattactgcaggtcatatacaatcagcaacacttatgtcttcgggactgggaccaagatcaccgtctaggtcagcccaaggcccaaacccactgtcta

SEQ ID NO: 562985 - DNA, 526 bp, Homo sapiens
  misc_feature: HIJSMM301C03NR.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggtccaacgggaccgaacggtagggaaggtacgaaacgaaacctacgtggcgtgcaccatctgtcttctatcttcccgccactctgat

SEQ ID NO: 562986 - DNA, 483 bp, Homo sapiens
  misc_feature: HIJSMM301BCP05.52.58.F03.1.454.light.4.raw
cgcagtacgacacgaccggtgctcgatttagtctgatcgagaagggaaagggggagtcagtctcagtcaggacacagcatggacatgagggtccccgctcagctcctggggctcctgctactctggctccgaggtgccagatgtgacacccagatgacccagtctccatcctccctgtctgcatctgtaggagacagagtcaccatcacttgccgggcaagtcagagcattggcaaatatttaaattggtatcagcagaaaccagggaaagcccctagactcctgatctatgctgcctccaatttgcaaagtggcgtcccatcgaggttcagtggccggggatctgggacagacttcactctcaccatcagcggtcttcaacctgaggactttggaacttactactgtcagcagagtgataatacccctcagactttcggccctggactacagtggatgtcaaacgaactgtggctgcaccat

SEQ ID NO: 562987 - DNA, 513 bp, Homo sapiens
  misc_feature: HIJSMM301AO5NB.12.53.E09.1.454.light.4.raw
atacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccgaagctgaccgtcctgggtcagcccaaggctgcccccttcggtcactctgttcccgccctcctctacgtcgtatctgagc

SEQ ID NO: 562988 - DNA, 484 bp, Homo sapiens; identical to SEQ ID NO: 544700
  misc_feature: HIJSMM301CH107.41.78.H01.1.454.light.4.raw

SEQ ID NO: 562989 - DNA, 489 bp, Homo sapiens
  misc_feature: HIJSMM301B131F.17.25.C03.1.454.light.4.raw
cgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacagatttcaatctcaccatcaccactctgcaacctgaggattgtgcaatctactactgtcaacagagttacagttcccctcgcacttttggccaggggaccaaagttgagatcaaacgaaacctgtggctgcaccatctgtt

SEQ ID NO: 562990 - DNA, 460 bp, Homo sapiens; identical to SEQ ID NO: 539553
  misc_feature: HIJSMM301ETIYO.11.86.H09.1.454.light.4.raw

SEQ ID NO: 562991 - DNA, 481 bp, Homo sapiens; identical to SEQ ID NO: 551571
  misc_feature: HIJSMM301A1AWO.41.60.F05.1.454.light.4.raw

SEQ ID NO: 562992 - DNA, 517 bp, Homo sapiens
  misc_feature: HIJSMM301D2HAG.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcgtccgacggaccgaacggtaggaaagtacaagacgaacgtacgtggcgtcgcgaccactctgtcttctactcttcccgt

SEQ ID NO: 562993 - DNA, 489 bp, Homo sapiens; identical to SEQ ID NO: 535091
  misc_feature: HIJSMM301EH0PJ.47.36.D03.1.454.light.4.raw

SEQ ID NO: 562994 - DNA, 501 bp, Homo sapiens; identical to SEQ ID NO: 537545
  misc_feature: HIJSMM301DF1AY.49.69.G03.1.454.light.4.raw

SEQ ID NO: 562995 - DNA, 434 bp, Homo sapiens; identical to SEQ ID NO: 560697
  misc_feature: HIJSMM301D771S.41.8.A08.1.454.light.4.raw

SEQ ID NO: 562996 - DNA, 496 bp, Homo sapiens; identical to SEQ ID NO: 541091
  misc_feature: HIJSMM301BB54P.22.9.A09.1.454.light.4.raw

SEQ ID NO: 562997 - DNA, 488 bp, Homo sapiens; identical to SEQ ID NO: 539612
  misc_feature: HIJSMM301AJLY1.3.55.E11.1.454.light.4.raw

SEQ ID NO: 562998 - DNA, 521 bp, Homo sapiens; identical to SEQ ID NO: 539470
  misc_feature: HIJSMM301BFMEO.27.23.C01.1.454.light.4.raw

SEQ ID NO: 562999 - DNA, 446 bp, Homo sapiens; identical to SEQ ID NO: 555110
  misc_feature: HIJSMM301CO7MF.18.9.A09.1.454.light.4.raw

SEQ ID NO: 563000 - DNA, 505 bp, Homo sapiens
  misc_feature: HIJSMM301DS2GM.8.71.G05.1.454.light.4.raw
ctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccagggaaagcccctaaatacctggtctatactgcatccactttgcaaagtggggtcccatcaaggttcagtggcagtggatttgggacagttttcactctcacaatcagcagtctcgaacctgaagattttgcaacttactactgtcaacagacttacaatataccgaggacgttcggtcaagggaccaaggtggagatcaaacgaactagtggctgcaccatctgtcttcatcttccgccat

SEQ ID NO: 563001 - DNA, 491 bp, Homo sapiens; identical to SEQ ID NO: 548535
  misc_feature: HIJSMM301BX8T8.51.71.G05.1.454.light.4.raw

SEQ ID NO: 563002 - DNA, 510 bp, Homo sapiens
  misc_feature: HIJSMM301AVI0Y.9.1.A01.1.454.light.4.raw
tgatacgtctcacgaccggtgctcgatttagacgtctcatcagggggagctgctcagttaggacccagagggaaccatggaaaccccacgcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaaggacgacgactggaggaattaaaggaacgtagttggcgtgcacccactcttcgtctttcctatctttcccccg

SEQ ID NO: 563003 - DNA, 479 bp, Homo sapiens; identical to SEQ ID NO: 535118
  misc_feature: HIJSMM301BAN3P.13.59.F04.1.454.light.4.raw

SEQ ID NO: 563004 - DNA, 489 bp, Homo sapiens
  misc_feature: HIJSMM301C2TQ7.4.52.E08.1.454.light.4.raw
agcactgtagcacgaccggtgctcgatttagtcgagctctcagagagaaaggggcagagccctggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccgacagggccactggcatcccagccaggttcagtggcagtgggtctgggacagacttcactctcaccatcaccagcctagagcctgaggattttgcagtttattactgtcagcagcgtagcaactggcctctgctcactttcggcggagggaccaaggtggagatcaaacgaact

SEQ ID NO: 563005 - DNA, 504 bp, Homo sapiens; identical to SEQ ID NO: 535709
  misc_feature: HIJSMM301DIGNF.9.55.E11.1.454.light.4.raw

SEQ ID NO: 563006 - DNA, 487 bp, Homo sapiens; identical to SEQ ID NO: 536025
  misc_feature: HIJSMM301B1AC3.17.34.D01.1.454.light.4.raw

SEQ ID NO: 563007 - DNA, 485 bp, Homo sapiens; identical to SEQ ID NO: 535880
  misc_feature: HIJSMM301ELGZU.7.75.G09.1.454.light.4.raw

SEQ ID NO: 563008 - DNA, 519 bp, Homo sapiens
  misc_feature: HIJSMM301DQEIM.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggtccgaaggaccgaacggtaggaagtacgaaacgaactagtggcgtgcaccactactgtcttctatcttcccgtccctact

SEQ ID NO: 563009 - DNA, 463 bp, Homo sapiens; identical to SEQ ID NO: 535062
  misc_feature: HIJSMM301AN410.11.73.G07.1.454.light.4.raw

SEQ ID NO: 563010 - DNA, 504 bp, Homo sapiens
  misc_feature: HIJSMM301AQHGO.15.86.H09.1.454.light.4.raw
tctacgtagccacgaccggtgctcgatttagtgctatagacttgggtttggggggacttccctggtctccttctacctactgcccttcatttctccacaggtctctgtgctctgcctgtgctgactcagcccccgtcctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctggtcactctgttcccaccctcctcg

SEQ ID NO: 563011 - DNA, 498 bp, Homo sapiens
  misc_feature: HIJSMM301BYNF2.22.9.A09.1.454.light.4.raw
acatacgcgtcacgaccggtgctcgatttagcgagacgcgcagggggaggaactgctcagttaggacccagagggaaccatggaagccccagctcagcttctcttcctcctgctactcgtggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcagtgggtctggaagagacttcactctcaccatcaacagcctagagcctgacgattctgcagtttattactgtcagcagcgtaccaagtggcctccgacttttggccagggggccaagctggagatcagacgaactgtggctgcaccatctgtcttcatcttccccg

SEQ ID NO: 563012 - DNA, 480 bp, Homo sapiens
  misc_feature: HIJSMM301D160N.52.53.E09.1.454.light.4.raw
  modified_base (434)..(434): a, c, t, g, unknown or other
  modified_base (449)..(449): a, c, t, g, unknown or other
cgcagtacgacacgaccggtgctcgatttagagagagtgtgttgggtttggggcagcctcagcagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacgtatccctgatcgcttctcaggctccggctctgggactgagcgctacctcaccatctccagcctccagtctgaggacgagggtgactattactgtcagacgtgggaacnctggcatttggggtnttcgggcggagggaccaagttgaccgtccta

SEQ ID NO: 563013 - DNA, 508 bp, Homo sapiens
  misc_feature: HIJSMM301ESF1N.51.38.D05.1.454.light.4.raw
cgatcgtatacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccagcctcggtgtcagtgtccccaggacagacggccaagatcccctgctctggagatgcattgccaaaacgatttgctttttggtaccaacagaagccaggccaggcccctataataattatatataaagacagtgagaggccctcagggatccctgagcgattctctggctccagctcagggacaacagccacgttgacgattagtggagtccaggcagaagacgaggctgactattactgtcaatcagcagacgacagtggtacttatggagtattcggcggagggaccaaggtgaccgtcctaggtcagccaaggctgccccctcggtcactctgttccccg

SEQ ID NO: 563014 - DNA, 520 bp, Homo sapiens
  misc_feature: HIJSMM301CS5W1.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctccgtggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgctagtttactactgtcagcagtatgttacgtccccgtggacgttcggccaagggaccaaggtggcaatcaaccgaactgtggctgcaccatctgtcttcatcttccccg

SEQ ID NO: 563015 - DNA, 489 bp, Homo sapiens
  misc_feature: HIJSMM301B7M7A.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatctccccactttcgccctggaccgaaagtaggatatacaaacgaactagtggctgcaccactctgtt

SEQ ID NO: 563016 - DNA, 500 bp, Homo sapiens; identical to SEQ ID NO: 546613
  misc_feature: HIJSMM301BPQ3F.11.21.B10.1.454.light.4.raw

SEQ ID NO: 563017 - DNA, 497 bp, Homo sapiens; identical to SEQ ID NO: 534982
  misc_feature: HIJSMM301C5VHH.26.80.H03.1.454.light.4.raw

SEQ ID NO: 563018 - DNA, 507 bp, Homo sapiens; identical to SEQ ID NO: 561702
  misc_feature: HIJSMM301DU46S.5.24.C02.1.454.light.4.raw

SEQ ID NO: 563019 - DNA, 462 bp, Homo sapiens
  misc_feature: HIJSMM301AJDX9.11.86.H09.1.454.light.4.raw
cgagagataccacgaccggtgctcgatttagtgctatagacttgggtttgggggccgttcctgggcccagtctgtgctgactcagccaccctcagcgtctgggacccccgggcagagggtcatcatctcttgttctggaagcagctctaatatcggaagtaatactgtaaattggtatcaacaactcccaggaacggcccccaaacctcctcatctatagtaataatcagcggccctcaggggtccctgaccgattctctggctccaagtctggcacctcagcctccctggccatcagtgggctccagtctgatgatgaggctgattattactgtgcagcatgggatgacaccctgaatggtccttgtgtggttttcggcggagggaccaagctgaccgtcctaggtcagcccaaggctgccccctccggtcactctgttcccaccctcctcgtatctctcg

SEQ ID NO: 563020 - DNA, 494 bp, Homo sapiens; identical to SEQ ID NO: 554590
  misc_feature: HIJSMM301EGFRZ.10.79.H02.1.454.light.4.raw

SEQ ID NO: 563021 - DNA, 473 bp, Homo sapiens
  misc_feature: HIJSMM301C7XHH.4.54.E10.1.454.light.4.raw
agcactgtagcacgaccggtgctcgatttagatcgtagcagaacacacaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcagcatcacttgccgggcaagtcagagcattagctacttttttaagttggtatcagcagacaccagggaaagcccctaagctcctgatctatgctgcttccagtttgcaaagtgggtcccatcaaggttcagtggcagtggatctgggacagatctcactctcactgtcagcagtctgcaatttgaagtattttgctaacttactactgtcaacagagtttcagtatcccttggactttcggccaagggaccaaggtggaaatcaaacgaa

SEQ ID NO: 563022 - DNA, 492 bp, Homo sapiens; identical to SEQ ID NO: 536010
  misc_feature: HIJSMM301CBB5H.10.20.B09.1.454.light.4.raw

SEQ ID NO: 563023 - DNA, 497 bp, Homo sapiens; identical to SEQ ID NO: 535664
  misc_feature: HIJSMM301D671I.22.14.B03.1.454.light.4.raw

SEQ ID NO: 563024 - DNA, 499 bp, Homo sapiens; identical to SEQ ID NO: 550763
  misc_feature: HIJSMM301A027J.19.78.H01.1.454.light.4.raw

SEQ ID NO: 563025 - DNA, 496 bp, Homo sapiens; identical to SEQ ID NO: 540261
  misc_feature: HIJSMM301CIQ6O.3.78.H01.1.454.light.4.raw

SEQ ID NO: 563026 - DNA, 491 bp, Homo sapiens
  misc_feature: HIJSMM301APOZC.13.46.E02.1.454.light.4.raw
tcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatcagcagggtggaggctgaggatgttattgggctctattattgcatgcaagcaacacactggccgtcacttttggccagggaccaagctggagatcaatcgaactgtggc

SEQ ID NO: 563027 - DNA, 460 bp, Homo sapiens; identical to SEQ ID NO: 536053
  misc_feature: HIJSMM301ALUXO.22.28.C06.1.454.light.4.raw

SEQ ID NO: 563028 - DNA, 496 bp, Homo sapiens; identical to SEQ ID NO: 535109
  misc_feature: HIJSMM301A7BAC.16.78.H01.1.454.light.4.raw

SEQ ID NO: 563029 - DNA, 464 bp, Homo sapiens; identical to SEQ ID NO: 537214
  misc_feature: HIJSMM301BEPUI.18.59.F04.1.454.light.4.raw

SEQ ID NO: 563030 - DNA, 488 bp, Homo sapiens; identical to SEQ ID NO: 535990
  misc_feature: HIJSMM301COABX.11.28.C06.1.454.light.4.raw

SEQ ID NO: 563031 - DNA, 519 bp, Homo sapiens
  misc_feature: HIJSMM301DCX0H.49.55.E11.1.454.light.4.raw
agtcgagagacacgaccggtgctcgatttagcactcgcacgttgggtttgggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaccaaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcacagaggaatattcggcggagggaccaagctgaccgtcctaggtcagcccaaggctgccccctcggtcactctgttcccaccctcct

SEQ ID NO: 563032 - DNA, 482 bp, Homo sapiens
  misc_feature: HIJSMM301C94KY.5.45.E01.1.454.light.4.raw
atcagacacgcacgaccggtgctcgatttagtgagtcagtaagggaaagggggagtcagacccagtcaggacacagcatggacatgagggtccccgctcagctcctggggctcctgctgctctggttcccaggttccagatgcgacatccagatgacccagtctccttctttcgtgtctgcgtctgtaggagacagacttactatcgcttgtcgggcgagtcaggatattagtaccaggttagcctggtatcagcagaagcctgggagagcccctaaactcctgatctatgctgcatcaagtctgcaaagtgggtcccatcgaggttcagaggcagtggatctgggacagatttcactctcaccatcagcggcctgcagcctgaagattatgcaacttactattgtcaaagttctaatgctttcccgcgcacgtttggccaggggaccaaggtagagatcaaacgaactgtggctgcaccat

SEQ ID NO: 563033 - DNA, 505 bp, Homo sapiens; identical to SEQ ID NO: 535503
  misc_feature: HIJSMM301DQG5M.8.28.C06.1.454.light.4.raw

SEQ ID NO: 563034 - DNA, 504 bp, Homo sapiens; identical to SEQ ID NO: 561069
  misc_feature: HIJSMM301DL9CK.19.78.H01.1.454.light.4.raw

SEQ ID NO: 563035 - DNA, 492 bp, Homo sapiens; identical to SEQ ID NO: 535126
  misc_feature: HIJSMM301EA5NA.18.11.A11.1.454.light.4.raw

SEQ ID NO: 563036 - DNA, 509 bp, Homo sapiens
  misc_feature: HIJSMM301DJ50R.5.58.F03.1.454.light.4.raw
atcagacacgcacgaccggtgctcgatttagtctgatcgagaagggaaagggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcacacttttatgttcgggactgggaccaaggtcaccgtcctaggtcagcccaaggccaaccccactgtcactctcg

SEQ ID NO: 563037 - DNA, 503 bp, Homo sapiens
  misc_feature: HIJSMM301ED9GE.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtggaaatcaaacgaactgtggctgcaccatctgtcttctatcttccccg

SEQ ID NO: 563038 - DNA, 500 bp, Homo sapiens
  misc_feature: HIJSMM301AIYBQ.4.59.F04.1.454.light.4.raw
agcactgtagcacgaccggtgctcgatttagtacacacacttagggagttgggggaggaactgctcagttaggacccagacggaaccatggaagccccagcgcagcttctcttcctcctgctactctggctcccagataccactggagaaataatattgacgcagtctccagccaccctgtctgtgtctccaggggaaagagccaccctctcctgcagggccagtcagagtgttagcagcaacttagcctggtaccagcagaagcctggccagactcccaggctcctcatctttggtgcattcaccagggccactgatatcccaaccaggttcagcggcagtgggtctgggacagagttcactctcaccatcagcaacctgcagtctgaagattctgcagtttattattgtcaccagtattatagttggcctccgtggacgttcgccgaagggaccgaaggtaggaaatacaaacgaactgtggctgcaccatctgtctt

SEQ ID NO: 563039 - DNA, 487 bp, Homo sapiens
  misc_feature: HIJSMM301BNM5I.47.46.E02.1.454.light.4.raw
agctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagcctaccctgtctgtctctccaggggaaagagccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctgaagattttgcagtttattactgtcagcagtatcataactggccgctcaccttcggccaagggacacggactggagattaaacgaactgtggctgcaccat

SEQ ID NO: 563040 - DNA, 489 bp, Homo sapiens; identical to SEQ ID NO: 546040
  misc_feature: HIJSMM301CEOH4.11.12.B01.1.454.light.4.raw

SEQ ID NO: 563041 - DNA, 519 bp, Homo sapiens
  misc_feature: HIJSMM301DKB33.27.23.C01.1.454.light.4.raw
agcgtcgtctcacgaccggtgctcgatttagtacacgtgattagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaggtctgcctacacggcctccctgaccatctccgggctccagcctgaggacgaggctgattattattgtagttcatatacaaccagtgacacttgggtgttcggcggagggaccaggctgaccgtcctaggtcagccaaggctgcccctcggtcactctgttcccgcct

SEQ ID NO: 563042 - DNA, 480 bp, Homo sapiens
  misc_feature: HIJSMM301AMRPO.48.19.B08.1.454.light.4.raw
  modified_base (444)..(444): a, c, t, g, unknown or other
agtatacatacacgaccggtgctcgatttagtgagtcagtaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgctgctcatatgcaggcagctacacttgggtnttcggcggagggaccaagctgaccgtctaggtcacg

SEQ ID NO: 563043 - DNA, 503 bp, Homo sapiens
  misc_feature: HIJSMM301CVNWM.10.50.E06.1.454.light.4.raw
catagtagtgcacgaccggtgctcgatttagatctactgacaacacacaaggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcataattcatgatgtcaataatcggccctcagggtttctaatcgcttctctggcttcaagtctggcaacacggcctccctgaccatctctgggctccaggctgaggacgaggctgattattactgcagctcatatacaaccagcagcactcgggtgttcggcggagggaccaagctgaccggtcctaggtcagcccaaggctgccccccg

SEQ ID NO: 563044 - DNA, 513 bp, Homo sapiens
  misc_feature: HIJSMM301C76NH.12.85.H08.1.454.light.4.raw
atacgacgtacacgaccggtgctcgatttagtatcactcagtcgcgggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcaccatttcctgcaccggaaccaatagtgacgttggtcgttataactttgtctcctggtacaaacagcacccaggcaaagcccccaactcctgatttatgaggtcactattcggtcctcaggaatttctaatcgcttctctggttccaagtctggcaacacggcctccctgaccatctctggggtccaggctgaggacgaggctgattattactgcagttcatatacaagcacttccactctcgtggtgttcggcggtgggaccaagctgaccgtccaagtcagcccaaggctgccccctcggtcactctgttccca

SEQ ID NO: 563045 - DNA, 502 bp, Homo sapiens
  misc_feature: HIJSMM301BGEYA.48.55.E11.1.454.light.4.raw
agtatacatacacgaccggtgctcgatttagcactcgcacgttggggtttgggggggtcgacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcgttatgaccttgtctcctggtaccaacaacacccaggcaaagcccccaaactcttgatttatgagatcactaagcggccctcaggcgtttctaatcgcttctctggctccaagtctggcaacacggcctccctgacaatctctgggctccaggctgaggacgaggctgattattattgctgctcatatgcaggtggtactacttgggtgttcggcagagggaccaagctgaccgtcctaggtcagcccaaggctgccccccg

SEQ ID NO: 563046 - DNA, 487 bp, Homo sapiens
  misc_feature: HIJSMM301AVOM5.49.53.E09.1.454.light.4.raw
agtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagactttgagagggcctcagggacccctgagcgattctctggctccagctcagcgacaacagtcacgttgaccatcagtggagtccgggcagaggacgaggctgactattactgtcagtcatcagacagtagtggcacttctgtcgtattcggcggagggaccaagctgaccgtcctaggtcagcccaaggctccg

SEQ ID NO: 563047 - DNA, 487 bp, Homo sapiens
  misc_feature: HIJSMM301AKZP7.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccgaagctgaccgtcctgcgtcagcccaaggctgccccctcggtcactctgttcccgcccctcctcgctacgtaga

SEQ ID NO: 563048 - DNA, 504 bp, Homo sapiens
  misc_feature: HIJSMM301EN3DZ.48.25.C03.1.454.light.4.raw
agtatacatacacgaccggtgctcgatttagtagtgtagatttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggctcctcatttatgatacatccaccagggccactggtgtcccagccaggttcactggcggtgggtctgggacagagttcactctcaccatcagcagcctgcagtctgaagattttacattttattactgtcagcagtatcgtaagtggactccgacgtttggccaagggaccaaggtggaagtcaaacgaactgtggctgcaccatctgtcttcatcttcccgc

SEQ ID NO: 563049 - DNA, 517 bp, Homo sapiens
  misc_feature: HIJSMM301EVUNO.13.55.E11.1.454.light.4.raw
tcacgtactacacgaccggtgctcgatttagcactcgcacgttgggtttggggagcctgggcctcaggaagcagcatcgggggtgccgcagccatggcctggaccgctctcctgctgagcctccttgctcactttacagcttctgtggcctcctatgagttgactcagccactctcagtgtcagtggccccgggacagacggccacaattccctgtgagggaaacaaccttagaagtcagaatgtccactggtaccagcagaagtcaggccaggcccctgtggtggtcatctatagggataataaccggccctctgggatccctgaccgattctctggctccaactcggggaacacggccaccctgaccatcaacagagcccaagacggggatgaggctgactattattgtcaggtgtggggacagcaccacggtgatattcggcggcgggaccaagctgaccgtcctaggtcagcccaaggctgccccctcggtcactctgttcccgccctcctct

SEQ ID NO: 563050 - DNA, 495 bp, Homo sapiens; identical to SEQ ID NO: 536055
  misc_feature: HIJSMM301ELQDK.47.38.D05.1.454.light.4.raw

SEQ ID NO: 563051 - DNA, 501 bp, Homo sapiens; identical to SEQ ID NO: 536867
  misc_feature: HIJSMM301A24SG.5.86.H09.1.454.light.4.raw

SEQ ID NO: 563052 - DNA, 522 bp, Homo sapiens
  misc_feature: HIJSMM301E2V67.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcgggcggagggaccaggctgaccgtcctaggtcagcccaaggctgccccctcggtcactctgttcccaccct

SEQ ID NO: 563053 - DNA, 497 bp, Homo sapiens
  misc_feature: HIJSMM301ERWGB.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggtccaggctcccagactcctcatctctggtgcatcttcgagggccactggtgtcccagccaggttcagtggcagtgggtctggaacagagttcactctcaccatcagcggcctgcagtctgaagattttgcagtttattactgtcagcagtataatgactgggttttattctactttcggtccctcgggaccgaaagtggatttcagacgaactgtggctgcaccatctgtcttcta

SEQ ID NO: 563054 - DNA, 501 bp, Homo sapiens
  misc_feature: HIJSMM301C902S.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacgcgctcactttcggcggagggaccaaggtggagatcaaacgaactgtggctgcaccatct

SEQ ID NO: 563055 - DNA, 473 bp, Homo sapiens
  misc_feature: HIJSMM301B32MR.51.53.E09.1.454.light.4.raw
cgatcgtatacacgaccggtgctcgatttagagagagtgtgttgggtttgggggcagaagtctctctcagtcaggacacagcatggacatgagggtccctgctcagctcctgggactcctgctgctctggctcccagataccagatgtgacatccagatgacccagtctccatcctccctgtctgcatctataggagacagagtcaccatcacttgccgggcgagtcagggcgtcagcatttatttggcctggtatcagcagagaccagggaaagctcctaaactcctgatctatgaggcatccactttacaatcaggggtcccatctcgtttcagtggcagtggatctggggcacatttcactctcaccatcagcagcctgcagcctgacgatgttgcaacttattactgtcaaattataacagggccgttgcgctcactttcggcgggggaccaaggtggagatcaagacg

SEQ ID NO: 563056 - DNA, 501 bp, Homo sapiens; identical to SEQ ID NO: 549899
  misc_feature: HIJSMM301CJTCM.41.18.B07.1.454.light.4.raw

SEQ ID NO: 563057 - DNA, 521 bp, Homo sapiens; identical to SEQ ID NO: 538715
  misc_feature: HIJSMM301AI2FF.27.23.C01.1.454.light.4.raw

SEQ ID NO: 563058 - DNA, 514 bp, Homo sapiens; identical to SEQ ID NO: 541418
  misc_feature: HIJSMM301A94UQ.17.33.C11.1.454.light.4.raw

SEQ ID NO: 563059 - DNA, 502 bp, Homo sapiens
  misc_feature: HIJSMM301ANK71.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataattctgggtgttcggcggaggaccaaactgaccgtcctaggtcagcccaaggctgccccctcggtcactctgtt

SEQ ID NO: 563060 - DNA, 495 bp, Homo sapiens; identical to SEQ ID NO: 537415
  misc_feature: HIJSMM301CM7VO.4.27.C05.1.454.light.4.raw

SEQ ID NO: 563061 - DNA, 505 bp, Homo sapiens; identical to SEQ ID NO: 535987
  misc_feature: HIJSMM301CGI6U.18.37.D04.1.454.light.4.raw

SEQ ID NO: 563062 - DNA, 444 bp, Homo sapiens; identical to SEQ ID NO: 534993
  misc_feature: HIJSMM301DYBRP.5.9.A09.1.454.light.4.raw

SEQ ID NO: 563063 - DNA, 490 bp, Homo sapiens; identical to SEQ ID NO: 541244
  misc_feature: HIJSMM301C8EHO.41.44.D11.1.454.light.4.raw

SEQ ID NO: 563064 - DNA, 499 bp, Homo sapiens
  misc_feature: HIJSMM301B05IL.48.59.F04.1.454.light.4.raw
agtatacatacacgaccggtgctcgatttagtacacacacttagggattgggggaagagctgctcagttaggacccagagggaaccatggaaaccccagcgcagcttctcttcctcctgctactctggctcccagatgccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatt

SEQ ID NO: 563065 - DNA, 481 bp, Homo sapiens; identical to SEQ ID NO: 535993
  misc_feature: HIJSMM301CPB6E.21.25.C03.1.454.light.4.raw

SEQ ID NO: 563066 - DNA, 491 bp, Homo sapiens; identical to SEQ ID NO: 536549
  misc_feature: HIJSMM301CW8F8.47.55.E11.1.454.light.4.raw

SEQ ID NO: 563067 - DNA, 513 bp, Homo sapiens
  misc_feature: HIJSMM301C2CSU.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctggtcactctgttcccacctcctcgctacgtagac

SEQ ID NO: 563068 - DNA, 498 bp, Homo sapiens
  misc_feature: HIJSMM301BGZE1.16.9.A09.1.454.light.4.raw
tgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagcttccctcagtgtccgtgtccccgggacagacagccagcatcacctgctctggagataacctgggaagtaaatttacttctggtatcagcggaagccaggccagtcccctgtttggtcatctataaagataggaatcggccctcagacatccctgagcgattctctggctccagctctggaaacacagccactctgaccatcaccgggacccagactatggatgaagctgactattactgtcaggcgtgggacagcggcactgtggttttcggcggagggaccaagctgaccgtcctcggtcagcccaaggctgccccctcggtcactctgttcccacct

SEQ ID NO: 563069 - DNA, 472 bp, Homo sapiens; identical to SEQ ID NO: 536302
  misc_feature: HIJSMM301D0MAW.18.76.G10.1.454.light.4.raw

SEQ ID NO: 563070 - DNA, 508 bp, Homo sapiens
  misc_feature: HIJSMM301B8FQR.17.2.A02.1.454.light.4.raw
  modified_base (437)..(437): a, c, t, g, unknown or other
cgtagactagcacgaccggtgctcgatttagactcatctacaggggggtagagaagacaggactcaggacaatctccagcatggccagcttccctctcctcctcaccctcctcactcactgtgcagggtcctgggcccagtctgtactgactcagccaccctcagcgtctcgggacccccggacagagggtcaccatctcttgttctggaagcagctccaacatcgggactaatactgtaacctggttccagcacgtcccaggaacggccccaaactcgtcatgtataattatagtcagcggccctcaggggtccctgaccgattcgctggctccaactctggcacctcagcctccctggccatcagtgggctccagtctgaggatgaggctgattattactgtgcagcatgggatgccagcctgagtagtcccgtnttcggaactgggaccaaggtcaccgtcctagtcagcccaaggccaacccactgtcactctgttcccgccct

SEQ ID NO: 563071 - DNA, 504 bp, Homo sapiens
  misc_feature: HIJSMM301BFN26.48.79.H02.1.454.light.4.raw
agtatacatacacgaccggtgctcgatttagtgtcacacgaagggaaaggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcctcgggcgttcggtccaacgggaccgaacggtaggaaagtacaaacgaactagtggctggcacca

SEQ ID NO: 563072 - DNA, 447 bp, Homo sapiens; identical to SEQ ID NO: 535201
  misc_feature: HIJSMM301CGYCR.18.9.A09.1.454.light.4.raw

SEQ ID NO: 563073 - DNA, 496 bp, Homo sapiens
  misc_feature: HIJSMM301AEKA2.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcagggtacgactctggccgttcacttttggtccaggggaccgaaactaggatatcagacgaactagtggcgtgca

SEQ ID NO: 563074 - DNA, 520 bp, Homo sapiens
  misc_feature: HIJSMM301EA9NT.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagccaacggctgccccctcggtcactctgttcccgcct

SEQ ID NO: 563075 - DNA, 486 bp, Homo sapiens; identical to SEQ ID NO: 535385
  misc_feature: HIJSMM301C2DYY.19.71.G05.1.454.light.4.raw

SEQ ID NO: 563076 - DNA, 505 bp, Homo sapiens
  misc_feature: HIJSMM301C1S9X.47.55.E11.1.454.light.4.raw
agctcacgtacacgaccggtgctcgatttagcactcgcacgtagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctagggcacgtgagactcaggaaatgaccagaggggagtgaatgaggggtgcagagaactccatggctaccaggtcagcccaaggcccaacccccactgtcactctgttcccgccctcctcta

SEQ ID NO: 563077 - DNA, 496 bp, Homo sapiens; identical to SEQ ID NO: 535109
  misc_feature: HIJSMM301CWWFI.16.78.H01.1.454.light.4.raw

SEQ ID NO: 563078 - DNA, 489 bp, Homo sapiens; identical to SEQ ID NO: 536663
  misc_feature: HIJSMM301EHO6Y.16.72.G06.1.454.light.4.raw

SEQ ID NO: 563079 - DNA, 492 bp, Homo sapiens
  misc_feature: HIJSMM301CPLRD.15.59.F04.1.454.light.4.raw
tctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaagctgccctcaccatcacgggggcccaggcagatgatgaatctgtttattattgtgtcctatatatgggtgctggcatttcggtcttcggcggagggaccaagctgaccgtcctaggtcagcccaaggctgccccctggtcactctgttcccgccctcctcgctacgtaga

SEQ ID NO: 563080 - DNA, 434 bp, Homo sapiens; identical to SEQ ID NO: 553937
  misc_feature: HIJSMM301EWDB5.10.38.D05.1.454.light.4.raw

SEQ ID NO: 563081 - DNA, 501 bp, Homo sapiens
  misc_feature: HIJSMM301BA9Y5.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttatactgtcatcagagtactactttacctcaagtgatcacttcggccaagggacacgactggagattaaacg

SEQ ID NO: 563082 - DNA, 510 bp, Homo sapiens; identical to SEQ ID NO: 546105
  misc_feature: HIJSMM301CITOY.9.37.D04.1.454.light.4.raw

SEQ ID NO: 563083 - DNA, 516 bp, Homo sapiens
  misc_feature: HIJSMM301DXZYI.5.27.C05.1.454.light.4.raw
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccgggatgaggccgactattactgtcaggtgtggaatggtgattatgattatgtcttcggaactgggaccaaggtcaccgtcctaggtcagcccaaggccaaccccactgtcactctgttcccgccctcctccgt

SEQ ID NO: 563084 - DNA, 491 bp, Homo sapiens
  misc_feature: HIJSMM301EDLVF.10.72.G06.1.454.light.4.raw
catagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttgggatttctaatcgcttctctgcctccaagtctggcaacacggcttccctgaccatctccgggctccacgctgaggacgaggctcattattactgcagctcatatacacccaggggcactctcgtgatattcggcggagggacctggctgaccgtcctaggtcagcccaa

SEQ ID NO: 563085 - DNA, 493 bp, Homo sapiens; identical to SEQ ID NO: 535745
  misc_feature: HIJSMM301DK1XK.47.78.H01.1.454.light.4.raw

SEQ ID NO: 563086 - DNA, 451 bp, Homo sapiens
  misc_feature: HIJSMM301AQW6I.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtgagcccaaggctgccccctcggtcactctgttcccctcctccacgagagta

SEQ ID NO: 563087 - DNA, 492 bp, Homo sapiens; identical to SEQ ID NO: 557028
  misc_feature: HIJSMM301DVI7V.51.6.A06.1.454.light.4.raw

SEQ ID NO: 563088 - DNA, 484 bp, Homo sapiens; identical to SEQ ID NO: 536393
  misc_feature: HIJSMM301AXYI8.4.41.D08.1.454.light.4.raw

SEQ ID NO: 563089 - DNA, 517 bp, Homo sapiens
  misc_feature: HIJSMM301A4XND.8.87.H10.1.454.light.4.raw
ctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagtgtcagtggccctgggacagacggccagaattacctgtggaggagtcaacattgggacttcagatgtgcactggtaccagcagaagccaggccaggcccctgtactggtcatctttagcgattccaaccggccctctgggatccctgagcgattctctggctccaagtcggggaacacggccaccctgaccatcagcagggcccaacccttggatgaggtgactatttctgtcaagtgtgggacaccaacacttgtgtcttcgggactgggaccgaggtcaccgtcctaagtcagcccagggccaaccccactgtcactctgttcccaccctcctcgacacg

SEQ ID NO: 563090 - DNA, 516 bp, Homo sapiens
  misc_feature: HIJSMM301D1653.9.12.B01.1.454.light.4.raw
  modified_base (491)..(491): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgaggagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggctagtttattactgtcaactagttttcgtcggggtcgttcggaccgaacgggaccgaagggtaggaatacaaacgaactagtggtcngcacactctgtcttcatcttccccg

SEQ ID NO: 563091 - DNA, 506 bp, Homo sapiens
  misc_feature: HIJSMM301B4CTA.12.55.E11.1.454.light.4.raw
atacgacgtacacgaccggtgctcgatttagcactcgcacgttgggtttgggggtggtagctcaggaagcagagcctggagcatctccactatggcctgggctccactacttctcaccctcctcgctcactgcacaggttcttgggccagctttttgctgactcagccccactctgtgtcggggtctccggggaagacggtaaccatctcctgcaccggcagcagtggcaacattgccacgaagtatgtgcagtggtaccagcagcgcccgggcagtgcccccaccactataatctatgaggatgaccgacgaccctctggggtccctgatcgtttctctggctccatcgacagctcctccaattctgcctccctcaccatctctggactcatgtctgaggacgaggctgactactactgtcagtcttatgataatacgcttgttttttcggtcggtcgggaccaagctgaccgtcctaggtcagcccaagctgccccctcggtca

SEQ ID NO: 563092 - DNA, 485 bp, Homo sapiens
  misc_feature: HIJSMM301AMUSO.49.7.A07.1.454.light.4.raw
agtcgagagacacgaccggtgctcgatttagcacgtgtcgcaggggccttcaggccataatgagcgtctctgttttcagggtctctctcccagcctgtggtgactcaatcatcctctgcctctgcttccctgggatcctcggtcaagctcacctgcactctgagcagtgggcacagtacctacatcatcgcatggcataccagcagccagggaaggcccctcggtacttgatgaagcttgaacgtagtggaagcaacaacatggggggcggagttcctgatcgcttctcaggctccagttctgggcctgacttctacctcaccatctccagcctccagtctgaggatgaggctgattattactgtgagacctgggacagtaacactcatactccctcattcggcggagggaccaagctgaccgtcctaggtcagcccaaggctgccccctcggtcactctgttcccgccctcctctctctcgact

SEQ ID NO: 563093 - DNA, 487 bp, Homo sapiens; identical to SEQ ID NO: 536206
  misc_feature: HIJSMM301C2NXK.47.38.D05.1.454.light.4.raw

SEQ ID NO: 563094 - DNA, 484 bp, Homo sapiens
  misc_feature: HIJSMM301CZV00.26.55.E11.1.454.light.4.raw
agactatactcacgaccggtgctcgatttagcactcgcacgttgggtttgggggcaggagtcagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggcaagtgagggcataaacaaattcttaaattggtatcaggagaaaccagggagagcccctaaggtcctgatctatggtgcatccattttgcaaagtggggtcccaccaaatttcagtggcagtggatctgggacagatttcactctcagcattaataatctgcaacctgaggattttgcaacttactactgtcaacagagttacaggcccccctatacttttggccaggggaccaagctggagatcacagaactgtggctgcac

SEQ ID NO: 563095 - DNA, 508 bp, Homo sapiens; identical to SEQ ID NO: 537810
  misc_feature: HIJSMM301BMHZ7.4.71.G05.1.454.light.4.raw

SEQ ID NO: 563096 - DNA, 487 bp, Homo sapiens
  misc_feature: HIJSMM301DO77Q.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcatgcacagattttacactgaaaatcagcagagtggaggctgaggatgttgggctctattattgcatgcaagctctacaagtcccgctcactttcggcggagggaccaaaggtggagatcaaacgaacg

SEQ ID NO: 563097 - DNA, 447 bp, Homo sapiens; identical to SEQ ID NO: 535201
  misc_feature: HIJSMM301A57XF.18.9.A09.1.454.light.4.raw

SEQ ID NO: 563098 - DNA, 508 bp, Homo sapiens
  misc_feature: HIJSMM301D1Q2N.40.33.C11.1.454.light.4.raw
tctagcgactcacgaccggtgctcgatttagagtgagctcgttgggtttggggaaaggccctgaggaaaacaaaccccagctgggaagcctgagaacacttagccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagaccccaggccagcctccacgttcactcatcgtcagcacaagcagacgtttgcctggggtgcctgatcgcttctctgcctccatccttgggaacaaagctgccctcaccattacgggggcccagccagaggatgagtcttattattactgcatgctccatgtggggggtgccacttgggtgttcggcggaggaccaagctgaccgtccg

SEQ ID NO: 563099 - DNA, 504 bp, Homo sapiens; identical to SEQ ID NO: 560868
  misc_feature: HIJSMM301AOVLA.8.1.A01.1.454.light.4.raw

SEQ ID NO: 563100 - DNA, 482 bp, Homo sapiens
  misc_feature: HIJSMM301DO47D.19.71.G05.1.454.light.4.raw
tactctcgtgcacgaccggtgctcgatttagtgtcgtcgcaagagagaggaggtacaacaggcaggcaggggcagcaagatggtgttgcagacccaggtcttcatttctctgttgctctggatctctgatgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaa

SEQ ID NO: 563101 - DNA, 511 bp, Homo sapiens
  misc_feature: HIJSMM301ESJ9Y.17.2.A02.1.454.light.4.raw
  modified_base (438)..(438): a, c, t, g, unknown or other
cgtagactagcacgaccggtgctcgatttagactcatctacagggggggtagagaagacaggactcaggacaatctccagcatggccagcttccctctcctcctcaccctcctcactcactgtgcagggtcctgggcccagtctgtactgactcagccaccctcagcgtctgggacccccggacagagggtcaccatctcttgttctggaagcagctccaacatcgggactaatactgtaacctggttccagcacgtcccaggaacggtccccaaactcgtcatgtataattatagtcagcggccctcaggggtccctgaccgattcgctggctccaactctggcacctcagcctccctggccatcagtgggctccagtctgaggatgaggctgattattactgtgcagcatgggatgccagcctgagtagtcccgtnttcggaactgggaccaaggtcaccgtcctacgtcagcccaaggccaaccccactgtcactctgttcccgccct

SEQ ID NO: 563102 - DNA, 497 bp, Homo sapiens
  misc_feature: HIJSMM301DDPIB.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtctaggtcagcccaaggccaacccact

SEQ ID NO: 563103 - DNA, 496 bp, Homo sapiens; identical to SEQ ID NO: 538149
  misc_feature: HIJSMM301BXY71.13.67.G01.1.454.light.4.raw

SEQ ID NO: 563104 - DNA, 488 bp, Homo sapiens; identical to SEQ ID NO: 542699
  misc_feature: HIJSMM301AUY6W.12.51.E07.1.454.light.4.raw

SEQ ID NO: 563105 - DNA, 490 bp, Homo sapiens; identical to SEQ ID NO: 538999
  misc_feature: HIJSMM301BO1AU.16.86.H09.1.454.light.4.raw

SEQ ID NO: 563106 - DNA, 490 bp, Homo sapiens
  misc_feature: HIJSMM301DMVVF.3.55.E11.1.454.light.4.raw
agacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtatcccagccaggttcagtggcagtgggtctgggacagagttcattctcaccatcagcagcctgcagtctgaagattttgctaatttattactgtcagcagtataataactggtggacgttcggccaagggaccaaaggtagaaatcaaacgaactgtggctgcaccatctgtt

SEQ ID NO: 563107 - DNA, 492 bp, Homo sapiens
  misc_feature: HIJSMM301BA4I8.13.46.E02.1.454.light.4.raw
tcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatcagcagggtggaggctgaggatgttattgggctctattattgtcatgcaagcaacacactgccgtacacttttggccaggggccaagctggagatcaatcgaactgtggc

SEQ ID NO: 563108 - DNA, 514 bp, Homo sapiens; identical to SEQ ID NO: 541418
  misc_feature: HIJSMM301CBQCG.17.33.C11.1.454.light.4.raw

SEQ ID NO: 563109 - DNA, 493 bp, Homo sapiens; identical to SEQ ID NO: 535566
  misc_feature: HIJSMM301AETNZ.16.6.A06.1.454.light.4.raw

SEQ ID NO: 563110 - DNA, 493 bp, Homo sapiens
  misc_feature: HIJSMM301ARCRM.16.6.A06.1.454.light.4.raw
tgtactactccacgaccggtgctcgatttagatctactgacagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagcttggtaccagcagaaaccggggcagtctcctaagttgctcatttactgggcgtctacccgggaatccggggtccctgaccgattcagtggcagcgggtctgggacagatttcactctcaccatcagcagcctgcaggttgaagatgtggcagtttattactgtcagcagtattatactactcctctgacgttcggccaagggaccaaggtggagatcaaacgaactgtggctgcacat

SEQ ID NO: 563111 - DNA, 510 bp, Homo sapiens
  misc_feature: HIJSMM301AXYJL.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgccccctcggtcactctcgtt

SEQ ID NO: 563112 - DNA, 513 bp, Homo sapiens
  misc_feature: HIJSMM301DXNQS.14.7.A07.1.454.light.4.raw
cgtctagtaccacgaccggtgctcgatttagcacgtgtcgcagggggccctgaggaaaacaaaccccagctgggaagcctgagaacacttagccttcatgagtgtccccaccatggcctgcatgatgcttctcctcggactccttgcttatggatcaggagtggtttctcagactgtggtgacccaggaaccatcgttctcagtgtcccctggagagacaatcacactcacttgtggcttagactctggctcagtctccaccgctcattatcccagctggtaccggcagaccccaggccaggctccacggctcctcatttacagcacaaagaatcggtctttggggtccctgatcgcttctctggctccatccttgggaacaaggctgccctcaccatcacgggggcccaggcagatgatgaatctaattatcactgtgcgttgtatatgggttttggcatttcggtgttcggcggagggacccaggtgaccgtcctacgtcagcccaaggcc

SEQ ID NO: 563113 - DNA, 447 bp, Homo sapiens
  misc_feature: HIJSMM301CZQ7I.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcattctgttcccaccctcctccatactcgta

SEQ ID NO: 563114 - DNA, 491 bp, Homo sapiens
  misc_feature: HIJSMM301AL59T.40.57.F02.1.454.light.4.raw
tctagcgactcacgaccggtgctcgatttagctcgatatagttgggtttggggtggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttatttttgctgctcttatgcaggcagtttcgctctcgaagtgttcggcggagggaccgagctgaccgtcctacgtcagccc

SEQ ID NO: 563115 - DNA, 444 bp, Homo sapiens; identical to SEQ ID NO: 535411
  misc_feature: HIJSMM301ESOPU.8.73.G07.1.454.light.4.raw

SEQ ID NO: 563116 - DNA, 492 bp, Homo sapiens
  misc_feature: HIJSMM301CS92M.19.71.G05.1.454.light.4.raw
tactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaactgtgg

SEQ ID NO: 563117 - DNA, 488 bp, Homo sapiens
  misc_feature: HIJSMM301CL6N1.41.35.D02.1.454.light.4.raw
tctatactatcacgaccggtgctcgatttagcacacgatagttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggtaccatcagcgatgttgattattataaccttgtctcctggtaccaacaacacccaggcaaagcccccaaactcctgatttatgagggcgatcagcggccctcaggggtttctaatcgcttctctggctccaagtctggcaacacggcctccctgaccatctctgggctccaggctgaggacgaggctgattattactgcagctcatatacaagcagcagcactctcgtggtattcggcggagggaccagctgaccgtctaggtcagccc

SEQ ID NO: 563118 - DNA, 416 bp, Homo sapiens; identical to SEQ ID NO: 539343
  misc_feature: HIJSMM301BB5GB.18.78.H01.1.454.light.4.raw

SEQ ID NO: 563119 - DNA, 506 bp, Homo sapiens; identical to SEQ ID NO: 534969
  misc_feature: HIJSMM301B3ZOF.18.37.D04.1.454.light.4.raw

SEQ ID NO: 563120 - DNA, 494 bp, Homo sapiens; identical to SEQ ID NO: 534992
  misc_feature: HIJSMM301BNYJF.9.1.A01.1.454.light.4.raw

SEQ ID NO: 563121 - DNA, 492 bp, Homo sapiens
  misc_feature: HIJSMM301EJHE3.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcgtccacgggaccgaccggtggagtgttcaagacgaacgtacgtggcgtgcaccact

SEQ ID NO: 563122 - DNA, 501 bp, Homo sapiens
  misc_feature: HIJSMM301DUG9P.18.26.C04.1.454.light.4.raw
tacgagtatgcacgaccggtgctcgatttagtctagcgactttgggtttggggggtcagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaaagcccctaacctcctgatcaagggtccgtccagtttccagagtgggcctcaacaaggttcagcggcagtggatctgggacagatttcactctcaccatcaccagcctgcagcctgaagattttgcaacttactattgtcaacaggctgacaggttcccgctgactttcggcggagggaccgaaggtagagatcaaaggaactgtggctgcaccatctgtcttcatcttcccgccta

SEQ ID NO: 563123 - DNA, 495 bp, Homo sapiens; identical to SEQ ID NO: 535007
  misc_feature: HIJSMM301BF2H2.22.5.A05.1.454.light.4.raw

SEQ ID NO: 563124 - DNA, 493 bp, Homo sapiens; identical to SEQ ID NO: 536705
  misc_feature: HIJSMM301C2U7Y.10.33.C11.1.454.light.4.raw

SEQ ID NO: 563125 - DNA, 481 bp, Homo sapiens
  misc_feature: HIJSMM301AR4AD.49.30.C08.1.454.light.4.raw
agtcgagagacacgaccggtgctcgatttagtctgacgtcaaagggaaagggggagtcagacccagtcaggacacagcatggacatgagggtccccgctcagctcctggggctcctgctgctctggctcccaggtgccaaatgtgacatccagatgacccagtctccttcccttttgtctgcatctgttggagacagagtcaccatcacttgccgggccactgagaacattaatcgctggttggcctggtatcagcagaaaccagggaaagcccctgaggccctcatctatctggcgtctagtttagagagtggggtcccatcaagattcagcggcaatggatctgggacagaattcactctcaccattagcagcctgcagcctgatgatcttgcaacttattactgccaacattataatagttatatgtacattttggccaggggaccaagttggagatcaaacgaactgtggctgcacc

SEQ ID NO: 563126 - DNA, 470 bp, Homo sapiens; identical to SEQ ID NO: 535302
  misc_feature: HIJSMM301A9RVJ.13.76.G10.1.454.light.4.raw

SEQ ID NO: 563127 - DNA, 490 bp, Homo sapiens
  misc_feature: HIJSMM301BKETN.49.78.H01.1.454.light.4.raw
agtcgagagacacgaccggtgctcgatttagtgtgagtagtttgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcaacagcgtaccacaggattcactttcggccctgggaccagagtggatatcaaacgaactgtggctgcaccatctgtctt

SEQ ID NO: 563128 - DNA, 509 bp, Homo sapiens; identical to SEQ ID NO: 539359
  misc_feature: HIJSMM301AX9LP.47.85.H08.1.454.light.4.raw

SEQ ID NO: 563129 - DNA, 443 bp, Homo sapiens
  misc_feature: HIJSMM301AEZ48.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctcgccccctcggtcactctcgttcccgccctcctcgtatctctcg

SEQ ID NO: 563130 - DNA, 492 bp, Homo sapiens; identical to SEQ ID NO: 543155
  misc_feature: HIJSMM301DSAG0.10.53.E09.1.454.light.4.raw

SEQ ID NO: 563131 - DNA, 501 bp, Homo sapiens; identical to SEQ ID NO: 535032
  misc_feature: HIJSMM301BE5BF.9.12.B01.1.454.light.4.raw

SEQ ID NO: 563132 - DNA, 508 bp, Homo sapiens
  misc_feature: HIJSMM301AT4TS.41.4.A04.1.454.light.4.raw
tctatactatcacgaccggtgctcgatttagagtagtgatcaggggagagaagagctgctcagttaggacccagagggaaccatggaaaccccagcgcagcttctcttcctcctgctactctggctcccagaagccaccggagaagttgtgttgacgcagtctccggacaccctttctttgtctccaggacaaagagccaccctctcttgtagggccagtgagagtatttccggcaccttcttagcgtggtaccaacagcgacctggccaggctcccaggctcctcttctctgctgcgtatgccagggccgctggcatccctgacaggttcagtggcagtgggtctgggacagacttcactctcaccatcaatagactggagcctgaagattttgcaacatattactgtcaccagtttgcaatctcacccaggacgttcggccaagggaccgaacggtaggaaatacaagacgaactgtggctgcaccatctgtcttcatcttcccgt

SEQ ID NO: 563133 - DNA, 512 bp, Homo sapiens; identical to SEQ ID NO: 540108
  misc_feature: HIJSMM301A3ZEG.40.12.B01.1.454.light.4.raw

SEQ ID NO: 563134 - DNA, 510 bp, Homo sapiens
  misc_feature: HIJSMM301B8SG1.11.57.F02.1.454.light.4.raw
  modified_base (486)..(486): a, c, t, g, unknown or other
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattacttgtcaacagcgtagcagcaggcctccggcgacgttcggccaaggaccgaaggtggaagtcaagacgaactgtggctgnaccatctgtcttcatctccgtcca

SEQ ID NO: 563135 - DNA, 521 bp, Homo sapiens
  misc_feature: HIJSMM301EL1XQ.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagtttcatatacaaccagtgacacttgggtgttcggcggagggaccaggctgaccgtcctaggtcagcccaaggctgccccctcggtcactctgttcccgcct

SEQ ID NO: 563136 - DNA, 486 bp, Homo sapiens; identical to SEQ ID NO: 535043
  misc_feature: HIJSMM301DP30L.46.35.D02.1.454.light.4.raw

SEQ ID NO: 563137 - DNA, 498 bp, Homo sapiens
  misc_feature: HIJSMM301AF4MM.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggccagcagtggtaacattgtgatattcggcggagggaccaagggtgaccgtcctacgtcagcccaaggctgccccctcggtcactctcg

SEQ ID NO: 563138 - DNA, 494 bp, Homo sapiens; identical to SEQ ID NO: 534994
  misc_feature: HIJSMM301CAEUE.27.78.H01.1.454.light.4.raw

SEQ ID NO: 563139 - DNA, 499 bp, Homo sapiens
  misc_feature: HIJSMM301BXZDP.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccgagggaccaagctggagatacaaacgaactgtggctgacaccatctgtt

SEQ ID NO: 563140 - DNA, 353 bp, Homo sapiens
  misc_feature: HIJSMM301BY7UV.4.67.G01.1.454.light.4.raw
agcactgtagcacgaccggtgctcgatttagagtatacatattggttactatgactttgtctcgtggtaccaacaacacccaggcaaagcccccaaactcataatttatggtgtcactaagcggccctcaggggtccctgatcgcttctctggctccaagtctggcaacatggcctccctgaccatctctgggctccaggctgaggatgaggctgattactactgctgctcctttgcaggcgcctctgtctcaggcagctatgtcttcggaactgggaccgaagtgaccgtcctgggtcagccccaaggccaaccccactgtcactctgttcccaccctcctcctacagtgct

SEQ ID NO: 563141 - DNA, 502 bp, Homo sapiens; identical to SEQ ID NO: 554531
  misc_feature: HIJSMM301CP3XU.21.81.H04.1.454.light.4.raw

SEQ ID NO: 563142 - DNA, 486 bp, Homo sapiens; identical to SEQ ID NO: 535917
  misc_feature: HIJSMM301DH6WB.3.10.A10.1.454.light.4.raw

SEQ ID NO: 563143 - DNA, 496 bp, Homo sapiens; identical to SEQ ID NO: 560726
  misc_feature: HIJSMM301BQCSY.9.53.E09.1.454.light.4.raw

SEQ ID NO: 563144 - DNA, 485 bp, Homo sapiens
  misc_feature: HIJSMM301AY869.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgaggattttgcaacttattactgtctacaagattacacttaccctgggacgttcggccaagggaccgaaggtaggaaatacaaacgaactagtggctgcaccta

SEQ ID NO: 563145 - DNA, 502 bp, Homo sapiens
  misc_feature: HIJSMM301BWTQV.9.53.E09.1.454.light.4.raw
tgatacgtctcacgaccggtgctcgatttagagagagtgtgttgggtttgggggctttgcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggaccaaggtgaccgtcctaggtcagcccaaggctgccccctcggtcactctgttcccgcctcctcagacgtatcac

SEQ ID NO: 563146 - DNA, 416 bp, Homo sapiens; identical to SEQ ID NO: 535308
  misc_feature: HIJSMM301DQZNU.16.46.E02.1.454.light.4.raw

SEQ ID NO: 563147 - DNA, 502 bp, Homo sapiens; identical to SEQ ID NO: 550967
  misc_feature: HIJSMM301DLK0O.4.39.D06.1.454.light.4.raw

SEQ ID NO: 563148 - DNA, 498 bp, Homo sapiens
  misc_feature: HIJSMM301BPSD2.3.33.C11.1.454.light.4.raw
agacgcactccacgaccggtgctcgatttagagtgagctcgttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctcgccccccg

SEQ ID NO: 563149 - DNA, 498 bp, Homo sapiens
  misc_feature: HIJSMM301CUS04.19.71.G05.1.454.light.4.raw
tactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctggggcgagcgggccacgatacgaactgacaaggtccagccacaatcttttatacagttccaacaatgaaaactacttagcttggtaccagcagagaccaggacagcctcctaggctgctcatttactgggcatctacccgggaatccggggtccctgatcgattcagtggcagcgggtctgggacagatttcactctcaccatcagcagcctgcaggctgaagatgtggcagtttattattgtacaacaatattattatacttcgtggacgttcggccaagggaccaaggtggatatcagacgaactgttgg

SEQ ID NO: 563150 - DNA, 510 bp, Homo sapiens
  misc_feature: HIJSMM301D0MHF.49.23.C01.1.454.light.4.raw
agtcgagagacacgaccggtgctcgatttagtacacgtgattagggattgggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgccaaaaagatatgcttattggtaccatcagaagtcaggccaggcccctgtactggtcatctatgaggacaccaaacgaccctccgggatccctacgagattctctggctccagtttagggacagtggccaccctgacagtcagtggggcccaggtggaggatgagggtgattactactgttactcaacagacattactactactcatagggtgttcggcggagggaccaagctgaccgtcctaggtcagccaaggctgccccctcggtcactctgttcccacct

SEQ ID NO: 563151 - DNA, 509 bp, Homo sapiens; identical to SEQ ID NO: 547637
  misc_feature: HIJSMM301ED9NC.9.33.C11.1.454.light.4.raw

SEQ ID NO: 563152 - DNA, 444 bp, Homo sapiens; identical to SEQ ID NO: 534993
  misc_feature: HIJSMM301APADB.5.9.A09.1.454.light.4.raw

SEQ ID NO: 563153 - DNA, 414 bp, Homo sapiens
  misc_feature: HIJSMM301EZ1HX.48.39.D06.1.454.light.4.raw
agtatacatacacgaccggtgctcgatttagtgacatctcgcagttctttggggtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttcccgccatctgatatgtatact

SEQ ID NO: 563154 - DNA, 491 bp, Homo sapiens; identical to SEQ ID NO: 537488
  misc_feature: HIJSMM301EBML9.15.3.A03.1.454.light.4.raw

SEQ ID NO: 563155 - DNA, 490 bp, Homo sapiens; identical to SEQ ID NO: 538999
  misc_feature: HIJSMM301CNBRE.16.86.H09.1.454.light.4.raw

SEQ ID NO: 563156 - DNA, 511 bp, Homo sapiens
  misc_feature: HIJSMM301CGIPD.10.80.H03.1.454.light.4.raw
catagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctgtgggggagacagcattgaaagtgaagctgtccactggtaccagcagaggccaggccaggcccctgtactggtcctctatgatgatagtgaccggccctcagggatccctgagcgattctctggctccaactctgggaacacggccaccctgaccatcaccagggtcgaagccggggatgaggccgactattatgtcaggtgtggtatttcagtagtattcatccgggggttttcggcggagggaccaagctgaccgtctaggtcagcccaaggctgccccctcggtcactctgttccca

SEQ ID NO: 563157 - DNA, 523 bp, Homo sapiens
  misc_feature: HIJSMM301D3R07.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattatttattgtagttcatatacaaccagtgacacttgggtgttcggcggagggaccaggctgaccgtcctaggtcagcccaaggctcgccccctcggtcactctgttcccaccct

SEQ ID NO: 563158 - DNA, 505 bp, Homo sapiens
  misc_feature: HIJSMM301BIO5X.19.78.H01.1.454.light.4.raw
tactctcgtgcacgaccggtgctcgatttagtgtgagtagtttgggtttggggggtcgacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccactgtca

SEQ ID NO: 563159 - DNA, 498 bp, Homo sapiens
  misc_feature: HIJSMM301CKRJT.49.73.G07.1.454.light.4.raw
agtcgagagacacgaccggtgctcgatttagctctacgctcagggcacgaccggtgctcgatttagtctgatcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccagccaggttcagtggcagtgggtttgggacagacttcacgctcaccatcagcagcctagagcctgaagattttgcagtttattactgtcaacagcgtaccacaggattcactttcggccctgggaccagagtggatatcaaacgaac

SEQ ID NO: 563160 - DNA, 491 bp, Homo sapiens
  misc_feature: HIJSMM301CDOVY.4.4.A04.1.454.light.4.raw
agcactgtagcacgaccggtgctcgatttagagtagtgatcagggggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgtcgggcaagtcagagtattaatagttggttggcctggtatcaccagagaccaggagaggccccaaggctccttatttatgatgcctccactgtgattagtggggtcccaccaacgttcagcggcagtgggatctgggacatacttcactctcaccatcagcagcctgcagcctgatgatcttggaacttattactgccaacagtataattagtttttggacgtttcggccgaggggaccgaaggtacgaaatagagacgaactgtggctgcaccatctgtcttcta

SEQ ID NO: 563161 - DNA, 521 bp, Homo sapiens
  misc_feature: HIJSMM301CZVBU.41.19.B08.1.454.light.4.raw
tctatactatcacgaccggtgctcgatttagtgagtcagtaagggggcgtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagccccaaggccaaccccactgtcactctgttcccgcctcct

SEQ ID NO: 563162 - DNA, 486 bp, Homo sapiens; identical to SEQ ID NO: 536323
  misc_feature: HIJSMM301AU7YQ.10.2.A02.1.454.light.4.raw

SEQ ID NO: 563163 - DNA, 500 bp, Homo sapiens; identical to SEQ ID NO: 543443
  misc_feature: HIJSMM301BN8N9.48.78.H01.1.454.light.4.raw

SEQ ID NO: 563164 - DNA, 502 bp, Homo sapiens
  misc_feature: HIJSMM301A39C7.48.37.D04.1.454.light.4.raw
agtatacatacacgaccggtgctcgatttagtagcatactgttgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaatatgcttattggtaccagcagaagtcaggccaggcccctgtgctggtcatctttgaggacaacaaacgaccctccgggatccctgagagattctctggctccagctcagggacaatggccaccttgactatcaatggggcccaggtggacgatgaggctgactactactgttcctcaacagacagtagtggtgatcgagggctgttcggcggagggaccaagctgaccgtcctaagtcagcccaaggctgccccctcggtcactctcg

SEQ ID NO: 563165 - DNA, 512 bp, Homo sapiens
  misc_feature: HIJSMM301BXH7M.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggtccgaacgggaccgaaggtaggaaatacaaaacgaactagtggcgtgcaccatctgtcttcatctttccccg

SEQ ID NO: 563166 - DNA, 489 bp, Homo sapiens
  misc_feature: HIJSMM301BBDQA.14.55.E11.1.454.light.4.raw
  modified_base (466)..(466): a, c, t, g, unknown or other
  modified_base (471)..(471): a, c, t, g, unknown or other
  modified_base (477)..(477): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctaatctatgctgcatccagtttgcacagtggggtccctcaaggttcagtggcagtggatctgggacagatttcactctcaccgtcagcagtctgcaacctgaagattttgcaactactactgtcaacagagttacacgtacccccctctactttcggcggagggaccaaggcggagatcagacgaacngtggntgcacntctgtcttcatt

SEQ ID NO: 563167 - DNA, 504 bp, Homo sapiens
  misc_feature: HIJSMM301DGIHS.48.28.C06.1.454.light.4.raw
agtatacatacacgaccggtgctcgatttagagctcacgtattgggtttgggggctgtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaattttgttattggtaccaactgaagtcaggccaggcccctgtcctggtcatttatgaggacgaccagcgaccctccaggatccctgcgaggttctctggatcgaactcagggacattggccaccttgactatcactgggcccaggtggaggatgaaggtgactacttctgtttctcaacagacaccagtgacaatcatgcgattttcggcggagggaccaagctgaccgtcctgggtcagccaaggctgccccctcggtcactctgtt

SEQ ID NO: 563168 - DNA, 497 bp, Homo sapiens; identical to SEQ ID NO: 540789
  misc_feature: HIJSMM301AJWSU.9.67.G01.1.454.light.4.raw

SEQ ID NO: 563169 - DNA, 504 bp, Homo sapiens
  misc_feature: HIJSMM301CCY63.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaaacatgggatgacaatctgagcggttgggtgttcggcggagggaccaaactgaccgtcctaggtcagccccaa

SEQ ID NO: 563170 - DNA, 497 bp, Homo sapiens; identical to SEQ ID NO: 538296
  misc_feature: HIJSMM301EVN95.18.11.A11.1.454.light.4.raw

SEQ ID NO: 563171 - DNA, 483 bp, Homo sapiens; identical to SEQ ID NO: 544010
  misc_feature: HIJSMM301DS402.19.5.A05.1.454.light.4.raw

SEQ ID NO: 563172 - DNA, 521 bp, Homo sapiens
  misc_feature: HIJSMM301AJWHC.5.27.C05.1.454.light.4.raw
atcagacacgcacgaccggtgctcgatttagacgcgatcgaagggtttgggggtctgggcctaaggaagcagcactggtggtgcctcagccatggcctggacctttctcctcctcggcctcctctctcactgcacaggctctgtgacctcctatgtgttgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgttcccgccctcctccgtgt

SEQ ID NO: 563173 - DNA, 485 bp, Homo sapiens; identical to SEQ ID NO: 535880
  misc_feature: HIJSMM301EJM5O.7.75.G09.1.454.light.4.raw

SEQ ID NO: 563174 - DNA, 489 bp, Homo sapiens; identical to SEQ ID NO: 554939
  misc_feature: HIJSMM301CVE47.12.31.C09.1.454.light.4.raw

SEQ ID NO: 563175 - DNA, 506 bp, Homo sapiens
  misc_feature: HIJSMM301CH0U9.18.11.A11.1.454.light.4.raw
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtcccggggtccctgaccgattcagaggcaggcgggtctgggacagatttcactctcaccatcaccaacctgcaggctgaagatgtggcagtttattactgtcagcaatactatagtcctcctctcacggttcggcggagggaccaaggtggagatcaaaacgaactgtggctgcaccatctgtcctt

SEQ ID NO: 563176 - DNA, 485 bp, Homo sapiens; identical to SEQ ID NO: 535880
  misc_feature: HIJSMM301A5SL4.7.75.G09.1.454.light.4.raw

SEQ ID NO: 563177 - DNA, 488 bp, Homo sapiens
  misc_feature: HIJSMM301BLEYP.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggtcactggcatcccagccaggttcagtggcagtgagtctgggacagacttcactctcaccatcagcagcctagagcctgaagattttgcactttattactgtcagcagcgtagcaactggcctctcactttcggcggagggaccagggtggagatcagacgaactgtggctgcaccatct

SEQ ID NO: 563178 - DNA, 493 bp, Homo sapiens
  misc_feature: HIJSMM301C4NYI.10.79.H02.1.454.light.4.raw
catagtagtgcacgaccggtgctcgatttagtgtcacacgaagggaaagggggagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagatttgcagtgtattattgtcagcaatatggtaggtcacctgggacttttggccaggggaccaagctggagatcaacgaactgtggctgcaccatctgtcttcta

SEQ ID NO: 563179 - DNA, 505 bp, Homo sapiens; identical to SEQ ID NO: 536254
  misc_feature: HIJSMM301EVLX4.7.71.G05.1.454.light.4.raw

SEQ ID NO: 563180 - DNA, 486 bp, Homo sapiens; identical to SEQ ID NO: 535043
  misc_feature: HIJSMM301DE8ZH.46.35.D02.1.454.light.4.raw

SEQ ID NO: 563181 - DNA, 500 bp, Homo sapiens
  misc_feature: HIJSMM301C6WQ5.21.81.H04.1.454.light.4.raw
tcgtcgctcgcacgaccggtgctcgatttagtagtgtagattcgcggggggggtctcaggaggcagcgctctcgggacgtctccaccatggcctgggctctgctattctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacgaggctgattattactgcaggtcatatacaatcagcaacacttatgtcttcgggactgggaccaagatcaccgtcctaggtcagcccaaggccaaccccatgtca

SEQ ID NO: 563182 - DNA, 511 bp, Homo sapiens
  misc_feature: HIJSMM301BBSSI.10.75.G09.1.454.light.4.raw
catagtagtgcacgaccggtgctcgatttagtatagacatcaggggggggtctcaggaggcagcgctctcgggacgtctccaccatggcctgggctctgctattcctcaccctcctcactcagggcacaggttcctgggcccagtctgccctgtctcagcctgcctccgtgtctgggtctcctggacagtcgatcaccatctcctgcaatggaagcgaaagtgacattggttctttaaattttgtctcttggtaccaacagagcccagacaaagcccccaaaattatcatttctgctgtcagtaatcggccctcaggggtttctagtcgcttctctggctccaagtctggcaacacggcctccctgaccatctctgggctccaggctgaggacgaggctgattattattgcagctcatatacaaacaccaaagctttgatattcggcggagggaccaaactgaccgtccttcgtcagccaacggctgccccctcggtcactctgttcccta

SEQ ID NO: 563183 - DNA, 480 bp, Homo sapiens
  misc_feature: HIJSMM301CXHBU.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgaggtattttgcaacttattactgtctacaagattacacttaccctgggacgttcggccgaagggaccgaaggtaggaaagtacaaacgaacctagtgg

SEQ ID NO: 563184 - DNA, 476 bp, Homo sapiens; identical to SEQ ID NO: 556981
  misc_feature: HIJSMM301AG9KV.12.1.A01.1.454.light.4.raw

SEQ ID NO: 563185 - DNA, 497 bp, Homo sapiens; identical to SEQ ID NO: 536371
  misc_feature: HIJSMM301BXAGO.16.78.H01.1.454.light.4.raw

SEQ ID NO: 563186 - DNA, 501 bp, Homo sapiens; identical to SEQ ID NO: 536142
  misc_feature: HIJSMM301BQWEQ.15.1.A01.1.454.light.4.raw

SEQ ID NO: 563187 - DNA, 499 bp, Homo sapiens
  misc_feature: HIJSMM301BGL31.43.34.D01.1.454.light.4.raw
tgtgagtagtcacgaccggtgctcgatttagatcgtctgtgttgggtttgggggggtcgacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattggacgacggtcaccgtcctaggtcagcccaaggccaacccca

SEQ ID NO: 563188 - DNA, 445 bp, Homo sapiens; identical to SEQ ID NO: 537719
  misc_feature: HIJSMM301EKOT5.47.85.H08.1.454.light.4.raw

SEQ ID NO: 563189 - DNA, 490 bp, Homo sapiens; identical to SEQ ID NO: 535234
  misc_feature: HIJSMM301BI6QM.17.21.B10.1.454.light.4.raw

SEQ ID NO: 563190 - DNA, 444 bp, Homo sapiens; identical to SEQ ID NO: 535192
  misc_feature: HIJSMM301EEBXS.5.9.A09.1.454.light.4.raw

SEQ ID NO: 563191 - DNA, 504 bp, Homo sapiens
  misc_feature: HIJSMM301AIQX4.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaaatgtacttttcggcggagggaccaagctgaccgtcctggtcagcccaaggctacgcccctggtcta

SEQ ID NO: 563192 - DNA, 509 bp, Homo sapiens; identical to SEQ ID NO: 543266
  misc_feature: HIJSMM301EYBQQ.17.33.C11.1.454.light.4.raw

SEQ ID NO: 563193 - DNA, 506 bp, Homo sapiens; identical to SEQ ID NO: 561742
  misc_feature: HIJSMM301ARRK3.12.53.E09.1.454.light.4.raw

SEQ ID NO: 563194 - DNA, 491 bp, Homo sapiens; identical to SEQ ID NO: 535294
  misc_feature: HIJSMM301A5Y8U.16.68.G02.1.454.light.4.raw

SEQ ID NO: 563195 - DNA, 513 bp, Homo sapiens
  misc_feature: HIJSMM301BPHM4.43.23.C01.1.454.light.4.raw
tgtgagtagtcacgaccggtgctcgatttagtacacgtgattagggattggggctggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcgggggcaaagctgccctgacactgtcaggtgtgcagcctgaggacgaggctgactattactgcctgctcatatatggtggcgcgtgggtgttcggcggagggaccaagctgaccgtcctgggtcagcccaaggctgccccctcggtcactctgttcccaccct

SEQ ID NO: 563196 - DNA, 504 bp, Homo sapiens; identical to SEQ ID NO: 535495
  misc_feature: HIJSMM301BQWJZ.14.86.H09.1.454.light.4.raw

SEQ ID NO: 563197 - DNA, 494 bp, Homo sapiens; identical to SEQ ID NO: 558667
  misc_feature: HIJSMM301AJS4T.41.59.F04.1.454.light.4.raw

SEQ ID NO: 563198 - DNA, 501 bp, Homo sapiens
  misc_feature: HIJSMM301AT41V.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttacacttttggccaggggaccaaggtcgtaggagtataaccgaaaacgaacgtt

SEQ ID NO: 563199 - DNA, 497 bp, Homo sapiens
  misc_feature: HIJSMM301EUH9N.19.71.G05.1.454.light.4.raw
tactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccgaagggaccaaggtggataatcagacgaactgtggctgca

SEQ ID NO: 563200 - DNA, 493 bp, Homo sapiens
  misc_feature: HIJSMM301CJ5IM.43.55.E11.1.454.light.4.raw
tgtgagtagtcacgaccggtgctcgatttagcactcgcacgttgggtttgggaggacacagcatggacatgagggtccctgctcagctcctgggactcctgctgctctggctcccagcagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagattttctctcgtcatcactggtctacagtctgacgacggcgcaatgtacttctgtcaacactatgcctctcccccctacaactttcggtcaggggaccaagttgaacatcaatcgaactgtggctgcaccatctgtcttcattcttcccgccta

SEQ ID NO: 563201 - DNA, 493 bp, Homo sapiens; identical to SEQ ID NO: 535657
  misc_feature: HIJSMM301BO773.27.78.H01.1.454.light.4.raw

SEQ ID NO: 563202 - DNA, 513 bp, Homo sapiens; identical to SEQ ID NO: 558032
  misc_feature: HIJSMM301CXZQB.16.66.F11.1.454.light.4.raw

SEQ ID NO: 563203 - DNA, 494 bp, Homo sapiens; identical to SEQ ID NO: 535828
  misc_feature: HIJSMM301A9C35.3.36.D03.1.454.light.4.raw

SEQ ID NO: 563204 - DNA, 486 bp, Homo sapiens; identical to SEQ ID NO: 536329
  misc_feature: HIJSMM301AWP0T.21.4.A04.1.454.light.4.raw

SEQ ID NO: 563205 - DNA, 495 bp, Homo sapiens; identical to SEQ ID NO: 555261
  misc_feature: HIJSMM301ANG9I.51.71.G05.1.454.light.4.raw

SEQ ID NO: 563206 - DNA, 503 bp, Homo sapiens; identical to SEQ ID NO: 538884
  misc_feature: HIJSMM301DGXNW.27.78.H01.1.454.light.4.raw

SEQ ID NO: 563207 - DNA, 507 bp, Homo sapiens
  misc_feature: HIJSMM301BI8Q7.4.57.F02.1.454.light.4.raw
  modified_base (501)..(501): a, c, t, g, unknown or other
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggacaggcccctgtggtggtcgtccgttatgatagcgaccggcctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaacccactgtcactctnttccgt

SEQ ID NO: 563208 - DNA, 487 bp, Homo sapiens
  misc_feature: HIJSMM301A6GT5.41.39.D06.1.454.light.4.raw
tctatactatcacgaccggtgctcgatttagtgacatctcgcagttctttggggagagaagagctgctcagttaggacccagagggaaccatggaaaccccagcgcagcttctcttcctcctgctactctggctcccagataccaccgaagaaattgtgttgacgcagtctccaggcaccctgtctttgtctccaggagaaagagccaccctctcctgtagggccagtcagattgttagcagcggctacttagcctggttccagcagagacctggccaggctcccaggctcctcatctatgaagcgtccatcaggcccactggcatcccagacagattcagtggcagtgggtctgggacagacttcactctcaccatcagcggactggagcctgaagattttgcagtctattactgtcagcagtatggtggctcacctccgtacacctttggccaggggaccaagctggagatcaaacgaactgtgg

SEQ ID NO: 563209 - DNA, 486 bp, Homo sapiens
  misc_feature: HIJSMM301AON2B.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtaggtggaggctgaggatgttggggtttattactgcatgcaagtctacaaacttcctacacttttggtccaggggaccaagctggagatcaaacgaa

SEQ ID NO: 563210 - DNA, 500 bp, Homo sapiens
  misc_feature: HIJSMM301BTKBF.41.18.B07.1.454.light.4.raw
tctatactatcacgaccggtgctcgatttagtcgctgcgtaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccaagctgaccgtcctaggtcagcccaaggctgccccctcggtcactctgttccccg

SEQ ID NO: 563211 - DNA, 491 bp, Homo sapiens; identical to SEQ ID NO: 538021
  misc_feature: HIJSMM301DXHDU.3.72.G06.1.454.light.4.raw

SEQ ID NO: 563212 - DNA, 496 bp, Homo sapiens
  misc_feature: HIJSMM301CM1CT.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggtctaagggaccgagggtggaaagtcaaacgaaacgtgtggctgcaccatctgtcttc

SEQ ID NO: 563213 - DNA, 486 bp, Homo sapiens; identical to SEQ ID NO: 535043
  misc_feature: HIJSMM301C6RU5.46.35.D02.1.454.light.4.raw

SEQ ID NO: 563214 - DNA, 490 bp, Homo sapiens; identical to SEQ ID NO: 536855
  misc_feature: HIJSMM301ER4I0.16.68.G02.1.454.light.4.raw

SEQ ID NO: 563215 - DNA, 464 bp, Homo sapiens
  misc_feature: HIJSMM301CVKX7.52.8.A08.1.454.light.4.raw
cgcagtacgacacgaccggtgctcgatttagcatactctacaggggaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctcccgctcactttcggcggggggaccaaggtggagatcaagcgaa

SEQ ID NO: 563216 - DNA, 494 bp, Homo sapiens; identical to SEQ ID NO: 535828
  misc_feature: HIJSMM301DY0FD.3.36.D03.1.454.light.4.raw

SEQ ID NO: 563217 - DNA, 490 bp, Homo sapiens
  misc_feature: HIJSMM301B41CN.10.17.B06.1.454.light.4.raw
catagtagtgcacgaccggtgctcgatttagtcgatagtgaaggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgcagtctgaagatttgcagtttattactgtcagcagtatgatacctggcctccgtacacttttggccggggaccaaggctggaaatcaagcgaactgtggctgcaccatctgtcttcat

SEQ ID NO: 563218 - DNA, 510 bp, Homo sapiens; identical to SEQ ID NO: 553675
  misc_feature: HIJSMM301A50ON.51.27.C05.1.454.light.4.raw

SEQ ID NO: 563219 - DNA, 392 bp, Homo sapiens; identical to SEQ ID NO: 547445
  misc_feature: HIJSMM301BXXYH.10.86.H09.1.454.light.4.raw

SEQ ID NO: 563220 - DNA, 486 bp, Homo sapiens
  misc_feature: HIJSMM301BSTYY.5.34.D01.1.454.light.4.raw
atcagacacgcacgaccggtgctcgatttagatcgtctgtgttgggtttgggggagtcagacccagtcaagacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttccctccgaccttcggccaaggacacgacctggagattaaacgaactacgtggctgcaccta

SEQ ID NO: 563221 - DNA, 507 bp, Homo sapiens; identical to SEQ ID NO: 545328
  misc_feature: HIJSMM301COE7Z.8.33.C11.1.454.light.4.raw

SEQ ID NO: 563222 - DNA, 516 bp, Homo sapiens
  misc_feature: HIJSMM301EMP4Y.16.85.H08.1.454.light.4.raw
tgtactactccacgaccggtgctcgatttagtatcactcagtcgcggggctgggcctaaggaagcagcactggtggtgcctcagccatggcctggaccgttctcctcctcggcctcctctctcactgcacaggctctgtgacctcctatgtgctgactcagccaccctcggtgtcgttggccccaggacagacggccttaataacctgtgggggaagcaacattggaagcaaaaatgtgcactggtacatgcagaggccaggccaggcccctgttttggtcgtctatgatgataccgagcggccctcagggatccctgagcgattctccggctccaactctggtgacacggccaccctgaccatcaacagggtcgaagtcggggatgaggccgactattactgtcaggtgtgggatggtgttagtgatcgggcacttttcggcggagggacccaggctgaccgtcctaggtcagcccaaggctgccccctcggtcactctgttcccgccctcctcg

SEQ ID NO: 563223 - DNA, 496 bp, Homo sapiens; identical to SEQ ID NO: 538149
  misc_feature: HIJSMM301DLI0O.13.67.G01.1.454.light.4.raw

SEQ ID NO: 563224 - DNA, 502 bp, Homo sapiens; identical to SEQ ID NO: 541501
  misc_feature: HIJSMM301A806V.17.27.C05.1.454.light.4.raw

SEQ ID NO: 563225 - DNA, 490 bp, Homo sapiens
  misc_feature: HIJSMM301BREV5.48.10.A10.1.454.light.4.raw
agtatacatacacgaccggtgctcgatttagcgtcgatctcagggggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggaccttcgtccgacggacgacggtaggaagtacaaacgaaactagtggcgtgcaccactctgtctt

SEQ ID NO: 563226 - DNA, 511 bp, Homo sapiens
  misc_feature: HIJSMM301APAKD.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgtcgtcacgggacgacacgtagaaatagagacgaactacgtggcgtgtcgaccaactctgtcttctactcttcccgt

SEQ ID NO: 563227 - DNA, 418 bp, Homo sapiens
  misc_feature: HIJSMM301CLD4S.19.86.H09.1.454.light.4.raw
tactctcgtgcacgaccggtgctcgatttagtgctatagacttgggtttgggggccgttcctgggactttctgataccacatcacaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcgcaaggctgccccctcggtcactctgttcccaccctcctccacgagagta

SEQ ID NO: 563228 - DNA, 485 bp, Homo sapiens; identical to SEQ ID NO: 544818
  misc_feature: HIJSMM301BONSJ.13.36.D03.1.454.light.4.raw

SEQ ID NO: 563229 - DNA, 495 bp, Homo sapiens; identical to SEQ ID NO: 538269
  misc_feature: HIJSMM301BCUZ8.9.1.A01.1.454.light.4.raw

SEQ ID NO: 563230 - DNA, 497 bp, Homo sapiens
  misc_feature: HIJSMM301BXNIG.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaactgtgggctga

SEQ ID NO: 563231 - DNA, 504 bp, Homo sapiens; identical to SEQ ID NO: 543615
  misc_feature: HIJSMM301EKOFY.11.67.G01.1.454.light.4.raw

SEQ ID NO: 563232 - DNA, 494 bp, Homo sapiens
  misc_feature: HIJSMM301A6QP0.51.35.D02.1.454.light.4.raw
cgatcgtatacacgaccggtgctcgatttagcacacgatagttgggtttggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattatgtcaatcaacagacaccattggtacttatgtcttcggaactgcgaccaaggtcaccgtcctgggtcagcccaaggccaacccactgtcact

SEQ ID NO: 563233 - DNA, 496 bp, Homo sapiens
  misc_feature: HIJSMM301B1FKQ.40.23.C01.1.454.light.4.raw
tctagcgactcacgaccggtgctcgatttagtacacgtgattagggattggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtcttagcaactacttagtctggtaccaacagaaacctggccaggctcccaggctcctcatctatgatgcataccagcagggccactggcatcccagccaggttcagtggcagtgggtctgggacagacttcactctcaccatcagcggcctagagcctgaagactttgcagtttattactgtcagcagcgtaccaactggccgctcactttcggcggagggaccaaggtggagatcaaacgaactgtggctgcaccatctgtcttcat

SEQ ID NO: 563234 - DNA, 505 bp, Homo sapiens
  misc_feature: HIJSMM301DRNJQ.3.37.D04.1.454.light.4.raw
agacgcactccacgaccggtgctcgatttagtagcatactgttgggtttgggggggtctcaggaggcagcgctctcgggacgtctccaccatggcctgggctctgctattcctcaccctcctcactcagggcacagggtcctgggcccagtctgccctgagtcagcctgcctccgtgtctgggtctcctggacagtcgatcaccatctcctgcactggaaccagcagtgacgttggtagatataattatgtctcctggtaccaacaactcccaggcaaagcccccaaactgatgatttatgatgtcaataatcggccctcagggtttctaatcgcttctctggctccaagtctggcaacacggcctccctgaccatctctgggctccgagggtgaggacgaggctgattattactgcagctcatttacaagcagcaccactcaggtcttcggaactgggactaaggtcaccgtctaggtcagcccaaggcccaacccatgtcact

SEQ ID NO: 563235 - DNA, 505 bp, Homo sapiens; identical to SEQ ID NO: 535503
  misc_feature: HIJSMM301EEF1O.8.28.C06.1.454.light.4.raw

SEQ ID NO: 563236 - DNA, 519 bp, Homo sapiens
  misc_feature: HIJSMM301AHO2W.40.34.D01.1.454.light.4.raw
tctagcgactcacgaccggtgctcgatttagatcgtctgtgttgggtttggggtgttgggtttgggaacctatgaacattctgtaggggccactgtcttctccactacttctcaccctcctcgctcactgcacaggttcttgggccaattttatgctgactcagccccactctgtgtcggggtctccggggaagacggtaaccatctcctgcacccgcagtagtggcagcattgccagcaactatgtgcagtggtaccagcagcgcccgggcagttcccccaccactttaatctatgaggataacaaaagactctctggggtccctgatcggttctctggctccatcgacagctcctccaattctgcctccctcaccatctctggactgaagactgaggacgaggctgattattactgtcagagttatgatgacaccaattactgggtgttcggcggagggaccaagctgaccgtcctaggtcagcccaaggctgccccctcggtcactctgttcccta

SEQ ID NO: 563237 - DNA, 514 bp, Homo sapiens
  misc_feature: HIJSMM301EKGR8.16.83.H06.1.454.light.4.raw
tgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtggccccaggacagacggccagcataacctgtggggaaacggccttggacgtaaaagtgtgcactggtaccagcagaagccaggccaggcccctgtgctggtcgtctatgatgatagcgaccggccctcagggatccctgagcgattctctggctccaactctgggaacgcggccaccctgaccatcagcagggtcgaagccggggatgaggccgactattactgtcaggtgtgggatagtagtagtgatcattatgtcttcggatctgggaccagggtcaccgtcctaggtcagcccaaggccaacccactgtcactctgttcccaccctccc

SEQ ID NO: 563238 - DNA, 514 bp, Homo sapiens
  misc_feature: HIJSMM301DG3SZ.22.30.C08.1.454.light.4.raw
acatacgcgtcacgaccggtgctcgatttagtctgacgtcaaagggaaaggggagagctctggggagtctgcaccatggcttggaccccactcctcttcctcaccatcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggctgccccctcggtcactctgttcccaccctcct

SEQ ID NO: 563239 - DNA, 506 bp, Homo sapiens; identical to SEQ ID NO: 539721
  misc_feature: HIJSMM301CQIWI.3.79.H02.1.454.light.4.raw

SEQ ID NO: 563240 - DNA, 490 bp, Homo sapiens; identical to SEQ ID NO: 535234
  misc_feature: HIJSMM301B53L5.17.21.B10.1.454.light.4.raw

SEQ ID NO: 563241 - DNA, 488 bp, Homo sapiens; identical to SEQ ID NO: 536861
  misc_feature: HIJSMM301BFSXQ.12.88.H11.1.454.light.4.raw

SEQ ID NO: 563242 - DNA, 481 bp, Homo sapiens; identical to SEQ ID NO: 535993
  misc_feature: HIJSMM301BIW44.21.25.C03.1.454.light.4.raw

SEQ ID NO: 563243 - DNA, 477 bp, Homo sapiens; identical to SEQ ID NO: 542993
  misc_feature: HIJSMM301D8JGF.49.27.C05.1.454.light.4.raw

SEQ ID NO: 563244 - DNA, 499 bp, Homo sapiens
  misc_feature: HIJSMM301CE7YR.12.87.H10.1.454.light.4.raw
atacgacgtacacgaccggtgctcgatttagcagtactgcgttgggtttggggctgggcctcaggaagcagcatcggaggtgcctcagccatggcatggatccctctattcctcggcgtccttgcttactgcacaggttccgtggcctcgtatgacctgactcagccaccctctgtgtccgtgtccccaggacagacagtcacaatctcatgctctggagatgcagttgggggaaaagtttgctttctggtatcagcagaagccaggccagtcccctgtcttggtcatctataaggatagcaggcggccctcagggattcctgagcgattctccggctccaactccggcaacacagccactctgaccatcagcgggacccaggctctcgatgaggctgactattactgccaggcgtgggacagctccacttcccgttatgtcttcggaggtgggaccatggtcaccgtcctaggtcagcccaagacccaaccccactgt

SEQ ID NO: 563245 - DNA, 511 bp, Homo sapiens
  misc_feature: HIJSMM301D3311.13.4.A04.1.454.light.4.raw
tcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcagggtcagcccaaggccaaccccactgtcactctgtt

SEQ ID NO: 563246 - DNA, 510 bp, Homo sapiens
  misc_feature: HIJSMM301D5IFV.43.67.G01.1.454.light.4.raw
tgtgagtagtcacgaccggtgctcgatttagagtatacatattgggtttgggggagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgttatactccgccgacgttcgccggggaccgaccgtcggaatcaaacgaaactgtggcgtgcaccactctgtctt

SEQ ID NO: 563247 - DNA, 494 bp, Homo sapiens
  misc_feature: HIJSMM301CMWRG.26.75.G09.1.454.light.4.raw
agactatactcacgaccggtgctcgatttagtatagacatcaggggagagctgctcagttaggacccagagggaaccatggaaaccccagcgcagcttctcttcctcctgctactctggctcccagattccaccgcagaaattgtgctgacgcagtctcccgggaccctgtctttgtctccaggggaaagagccaccctctcctgcagggccagtcagagtgttagcaactactatttagcctggtaccaacagaagtctggccaggctccccggctcctcatctacggaacatccaaccgggccactggcatcccagacaggttcagtggcagtgggtctgagacagacttcactctcactatcagcagactggagcctgaagattttgcagtgtattactgtcagcagtatgctacctcatttcccgtgacttttggccaggggaccaagctggatatcaaacgaactgtggctgcaccatctgtcttcatt

SEQ ID NO: 563248 - DNA, 504 bp, Homo sapiens; identical to SEQ ID NO: 555616
  misc_feature: HIJSMM301A8H80.5.86.H09.1.454.light.4.raw

SEQ ID NO: 563249 - DNA, 460 bp, Homo sapiens
  misc_feature: HIJSMM301CL15J.18.78.H01.1.454.light.4.raw
tacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgccagtcctatgacatgaggctgagtggttcgtatgtcttcggatctgggaccaaggtcaccgtcctaagtcagcccaaggccaacccctctgtcactctgttcccgccctcctccatactcgta

SEQ ID NO: 563250 - DNA, 487 bp, Homo sapiens
  misc_feature: HIJSMM301DL8OY.5.40.D07.1.454.light.4.raw
atcagacacgcacgaccggtgctcgatttagtgatagagcgtaacaacagagggtgctcgatttagtgatagagcgtaacaacagaggggggaactgctcagttaggacccagacggaaccatggaagccccagcgcagcttctcttcctcctgctactctggctcccagataccattggagagatagtgatgacgcagtctccagccaccctgtctgtgtctccaggggaaagagccaccctctcctgcagggccagccagagtgtaagtagtaggttagcctggtatcagcagaaacctggccaggctcccaggctcctcatctatggtgcatctaccagggccactggtatcccagccaggttcagtggcagtgggtctgggacagagttcactctcaccatcagcagcctgcagtctgaagattttgctagtttattactgtcaacagtataatgactggtggacgttcggccaagggaccaa

SEQ ID NO: 563251 - DNA, 524 bp, Homo sapiens
  misc_feature: HIJSMM301BRMRE.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgacccatctccgggctccagcctgaggacgaggctgattattattgtagttcatatacaaccagtgacacttgggtgttcggcggagggaccaggctgaccgtcctaggtcagcccaaggctcgccccctcggtcactctcgttcccaccct

SEQ ID NO: 563252 - DNA, 519 bp, Homo sapiens
  misc_feature: HIJSMM301BDL37.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcaacagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcgggcgttcggtccgaacgggaccgaacggtaggaaagtacaaacgaaactacgtggctgcaccatctgtcttctactcttcccgtccc

SEQ ID NO: 563253 - DNA, 491 bp, Homo sapiens; identical to SEQ ID NO: 535176
  misc_feature: HIJSMM301AUXTY.13.39.D06.1.454.light.4.raw

SEQ ID NO: 563254 - DNA, 503 bp, Homo sapiens; identical to SEQ ID NO: 549005
  misc_feature: HIJSMM301CP66V.49.82.H05.1.454.light.4.raw

SEQ ID NO: 563255 - DNA, 505 bp, Homo sapiens
  misc_feature: HIJSMM301DTF30.10.70.G04.1.454.light.4.raw
catagtagtgcacgaccggtgctcgatttagtgtagtgtgaagggaaaggggggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcaggttatgatgtacactggtaccagcaacttcccggaacagcccccacgctcctcatctatggtgacaccaaccggccctcaggggtccctgagcgattctctgggtccaagtctggcacctcggcctccctggccatcactgggctccaggctgaggatgaggctgattattactgccagtcccatgacaacagcctgagtgtttgggtgttcggcggagggaccaagctgaccgtccttagtcagcccaaggctgccccctcggtcactctgttcccgccctcctcca

SEQ ID NO: 563256 - DNA, 496 bp, Homo sapiens
  misc_feature: HIJSMM301DUVBN.43.79.H02.1.454.light.4.raw
tgtgagtagtcacgaccggtgctcgatttagtgtcacacgaagggaaaggggcagcttcagctgtggtagagaagacaggattcaggacaatctccagcatggccggcttccctctcctcctcaccctcctcactcactgtgcagggtcctgggcccagtctgtgctgactcagtcaccctcagcgtctgggacccccgggcagagggtcaccatctcttgttctggaagcagctccaacatcggaagtaatactgtaaactggtaccagcagctcccaggaacggcccccaaactcctcatctacagtattaatcagcggccctcagggatccctgaccgattctctggctccaagtctggcgcctcagcctccctggccatcagtgggctccagtctgaggatgaggctgattattactgtgctgcatgggatgacagcctgaatgcttgggtgttcggcggagggaccaagctgaccgtcctaggtcagcccc

SEQ ID NO: 563257 - DNA, 492 bp, Homo sapiens
  misc_feature: HIJSMM301B3AWL.49.34.D01.1.454.light.4.raw
agtcgagagacacgaccggtgctcgatttagatcgtctgtgttgggtttgggggaactgctcagttaggacccagacggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttaggagcaacttagcctggtatcagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataatgtccgggctccggacactttcggcggaggggaccaaggtggagatcaaacgaactgtggctgcaccatctgtt

SEQ ID NO: 563258 - DNA, 485 bp, Homo sapiens; identical to SEQ ID NO: 535606
  misc_feature: HIJSMM301EOSGQ.47.46.E02.1.454.light.4.raw

SEQ ID NO: 563259 - DNA, 500 bp, Homo sapiens
  misc_feature: HIJSMM301BN5P6.5.86.H09.1.454.light.4.raw
atcagacacgcacgaccggtgctcgatttagtgctatagacttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctggctccagactgaggatgaggctgactattactgcagctcatttgcaggcagccgtatactcttcggcggagggaccaagctgaccgtcctaggtcagcccaaggctcgccccctcggt

SEQ ID NO: 563260 - DNA, 503 bp, Homo sapiens; identical to SEQ ID NO: 538884
  misc_feature: HIJSMM301AUI5K.27.78.H01.1.454.light.4.raw

SEQ ID NO: 563261 - DNA, 484 bp, Homo sapiens
  misc_feature: HIJSMM301ADDBH.47.46.E02.1.454.light.4.raw
agctcacgtacacgaccggtgctcgatttagactcatctacagggaaagggaaggaactgctcagttaggacccagacggaaccatggaagccccagcgcagcttctcttcctcctgctactctggctcccagagaccactggagaaatagtgatgacgcagtctccagccaccctgtctgtctctccaggggaaagagccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctgaagattttgcagtttattactgtcagcagtatcataactggccgctcaccttcggccaagggacacgactggagattaaacgaactgtggctgcaccat

SEQ ID NO: 563262 - DNA, 494 bp, Homo sapiens; identical to SEQ ID NO: 534994
  misc_feature: HIJSMM301D4W8C.27.78.H01.1.454.light.4.raw

SEQ ID NO: 563263 - DNA, 488 bp, Homo sapiens
  misc_feature: HIJSMM301ESRO6.4.36.D03.1.454.light.4.raw
agcactgtagcacgaccggtgctcgatttagctgcgtcacgatctctcttgggggtcagactcagtcaggacacagcatggacttgagggtccccgctcagctcctggggctcctgctgctctggctcccaggtgccaaatgtgacatccagatgacccagtctccttccaccctgtctgcatctgtgggggacagagtcaccatcacttgccgggccagtcagagtgttgataactggttggcctggtatcagcagaaaccagggaaagcccctaaactcctgatttatgatgcctccggtttggaaagtggggtcccatcaaggttcagcggcagtggatctgggacagaattcactctcaccatcagcagcctgcagcctgatgattttgcaacttattactgccaacagtattatagttattctttgacgttcggccaagggaccaaggtggaaatcaaacgaactgtggctgcaccatctgtt

SEQ ID NO: 563264 - DNA, 510 bp, Homo sapiens
  misc_feature: HIJSMM301BXIG3.17.28.C06.1.454.light.4.raw
cgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccgggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctggaccgtcctaagtcagcccaaggctgccccccg

SEQ ID NO: 563265 - DNA, 496 bp, Homo sapiens
  misc_feature: HIJSMM301EMQR4.48.28.C06.1.454.light.4.raw
agtatacatacacgaccggtgctcgatttagagctcacgtattgggtttgggggctacaacaggcaggcaggggcagcaagatggtgttgcagacccaggtcttcatttctctgttgctctggatctctggtgcctacggggacgtcgtgatgacccagtctccagactccctggcagtgtctctgggcgggagggccaccatcaactgcaagtccagccagagtattttatacagctcctacaataagagcgacttagcttggtaccagcagaaaccaggacagcctcctaagttgctcatttactgggcatctaaccggcaatccggggtccctgaccgattcagtggcagcgggtctgggacacatttcgctttcaccatcagcagcctgcaggctgaggatgtggcagtttattactgtcagcaatattatactactccgtggactttcggccaaggaccaaggtggaaatcagacgaactgtggctgcacc

SEQ ID NO: 563266 - DNA, 486 bp, Homo sapiens
  misc_feature: HIJSMM301EWPGR.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcacttcggtcggagggaccaaggtggagatacaaacgaaa

SEQ ID NO: 563267 - DNA, 518 bp, Homo sapiens; identical to SEQ ID NO: 535407
  misc_feature: HIJSMM301B9N9F.22.30.C08.1.454.light.4.raw

SEQ ID NO: 563268 - DNA, 479 bp, Homo sapiens
  misc_feature: HIJSMM301A922L.40.9.A09.1.454.light.4.raw
tctagcgactcacgaccggtgctcgatttagcgagacgcgcagggggagctacaacaggcaggcaggggcagcaagatggtgttgcagacccaggtcttcatttctctgttgctctggatctctggtgccaacggggacatcgtgatgacccagtctccagactccctggctgtgtctctgggcgagagggccaccatcaactgcaagtccagccagactgttttatacagctccaacaatgagaactacgttgcttggtaccagcagaaaccaggacagcctcctaagttgctcatttactgggcatctacccgggcatccggggtccctgaccgattcagtggcagcgggtctgggacagatttcactctcaccatcaacaacctgcaggctgaagatgtggcagtttattactgtcaacaatattctggtcaatctcattctttcggcggagggaccaaggtggagatcagacgaa

SEQ ID NO: 563269 - DNA, 354 bp, Homo sapiens; identical to SEQ ID NO: 535026
  misc_feature: HIJSMM301DXUPA.19.22.B11.1.454.light.4.raw

SEQ ID NO: 563270 - DNA, 480 bp, Homo sapiens
  misc_feature: HIJSMM301C79A7.49.86.H09.1.454.light.4.raw
agtcgagagacacgaccggtgctcgatttagtgctatagacttgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagacaaaaaccagggacacgcccctaaactcctgatcctcgatgcatccactttggaaacaggggtcccatcaaggttcagtggaagtggctctgggacagtattttactttcaccatcagcaggctgcagcctgaagatattgcaacatattactgtcaacagtatgatagtctcccgctcactttcgggcgggggaccgaaggtggagatcaagcgaactgtggctgcaa

SEQ ID NO: 563271 - DNA, 505 bp, Homo sapiens
  misc_feature: HIJSMM301AMYW7.2.21.B10.1.454.light.4.raw
acgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaggacaggcccctgtaattgtcatctatggaatctatggtaaaaacaaccggccctcagggatcccagaccgattctctggctcctactcaggaaacacagcttccttgaccatcactggggctcaggcggaagatgaggctgactattattgtaagtccggggacagaagtggtaattacatggtgttcggcggagggaccaagctgaccgtcctacgtcagcccaaggctgccccctcggtcact

SEQ ID NO: 563272 - DNA, 472 bp, Homo sapiens
  misc_feature: HIJSMM301BDFBN.12.7.A07.1.454.light.4.raw
atacgacgtacacgaccggtgctcgatttagcacgtgtcgcagggggcaggagtcagacccactcaggacacagcatggacatgagggtccccgctcagctcctggggctcctgctgctctggctcccaggtgccacatgtgccatccagatgacccagtctccatcctccctgtctgcatctataggagacagagtcgccatcagttgccgggcaagtcagtacattagaaatgatttagcctggtatcagcagaaaccagggacagcccctcagctcctgatctatgctgcatccaatttacaaactggggtcccatcaaggttcagcggcagtggatctgcaacagacttcaatctcaccatcagcagcctgcagcctgaagattttgcaatttattactgtctgcaggattacacataccctcgaacgttcggccaagggaccaaggtggaaatacaaacgaactagt

SEQ ID NO: 563273 - DNA, 518 bp, Homo sapiens
  misc_feature: HIJSMM301BKF8Y.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggcaacggaccgaaggtggcaatcaaccgaactgtggctgcaccatctgtcttcatcttccccg

SEQ ID NO: 563274 - DNA, 504 bp, Homo sapiens; identical to SEQ ID NO: 535935
  misc_feature: HIJSMM301EM6IH.18.78.H01.1.454.light.4.raw

SEQ ID NO: 563275 - DNA, 467 bp, Homo sapiens
  misc_feature: HIJSMM301DAXV1.49.4.A04.1.454.light.4.raw
agtcgagagacacgaccggtgctcgatttagagtagtgatcagggggcaggagtcagtcccaaccaggacacagcatggacatgagggtccctgctcagctcctggggctcctgctgctctggctctcaggtgccagatgtgtcatccagatgacccagtctccttcctccctgtctgcatctataggagacagaatcaccatcacttgccgggcgagtcgagacattagcatgtatctgaattggtatcagcaaaaaccagggacagcccctaaactcctgatcctcgatgcatccactttggagacaggggtcccatcaaggttcagtggaagtggctctgggacagattttactttcaccatcagcaggctgcagcctgaagatattgcaacatattactgtcaacagtatgatcgcctcccgctcactttcggcgggggaccaaggtggagatcaagcgaact

SEQ ID NO: 563276 - DNA, 519 bp, Homo sapiens; identical to SEQ ID NO: 544656
  misc_feature: HIJSMM301CV8HL.27.23.C01.1.454.light.4.raw

SEQ ID NO: 563277 - DNA, 442 bp, Homo sapiens; identical to SEQ ID NO: 557721
  misc_feature: HIJSMM301CKDRQ.11.3.A03.1.454.light.4.raw

SEQ ID NO: 563278 - DNA, 505 bp, Homo sapiens; identical to SEQ ID NO: 536117
  misc_feature: HIJSMM301CUS31.8.71.G05.1.454.light.4.raw

SEQ ID NO: 563279 - DNA, 510 bp, Homo sapiens
  misc_feature: HIJSMM301ASHY9.48.56.F01.1.454.light.4.raw
agtatacatacacgaccggtgctcgatttagcagacgtctgaacacacaaagggggtggtagctcaggaagcagagcctggagcatctccactatggcctggactccactacttctcaccctcctcgctcactgcacaggttcttgggccacttttaaactgactcagccccactccgtgtcggggtctccggggaagacggtaagcatcacctgcacccgcaccagtggcgacattgccagcaactttgtgcagtgggtccagcagcgcccgggccgttcccccgccactgtaatatatgaggacattcaaagaccttctggggtccctcctcgattctctggctccatcgacaggtcctccaactccgcctccctcttcatctctgaactgaagactgaggacgaggctgcttattactgtcagtcctctgatggcagcgcagttgtcttcggcggagggaccacactgaccgttatcggtcagcccaaggctgccccctcggtcact

SEQ ID NO: 563280 - DNA, 486 bp, Homo sapiens; identical to SEQ ID NO: 535523
  misc_feature: HIJSMM301C1R0W.22.73.G07.1.454.light.4.raw

SEQ ID NO: 563281 - DNA, 487 bp, Homo sapiens
  misc_feature: HIJSMM301DP40M.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcagcgtctggtttggaaagtgggtcccatcaaggttcagtggcgccggatctgggacagaattcactctcaccatcagcgggctccagtctgaggactctgcaacttattactgaccaacaatatgatattttatctccagcgttcggccaggggaccaaggtggaagtcaagcgaactgtggctgcaccatctgt

SEQ ID NO: 563282 - DNA, 489 bp, Homo sapiens
  misc_feature: HIJSMM301DVT5F.3.33.C11.1.454.light.4.raw
agacgcactccacgaccggtgctcgatttagagtgagctcgttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggc

SEQ ID NO: 563283 - DNA, 515 bp, Homo sapiens
  misc_feature: HIJSMM301BUWZG.8.23.C01.1.454.light.4.raw
ctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtggggggttcaatattggaggtaacaatgtgcactggtaccagcagaaggcagggcaggcccctgtactggtcatctatgggggatccatccggccaggtgggacccctgcgcgattctctgcctccatctcggggaacgcggccaccctgaccatcagcaaagcccaagccggtgatgaggctgactatttttgtcaggtgtgggacagcagcatttatgtcttcggacctgggaccaaggtcaccgtcctaggtcagcccaaggcccaaccccactgtcactctgttcccgccctcctcga

SEQ ID NO: 563284 - DNA, 512 bp, Homo sapiens; identical to SEQ ID NO: 541402
  misc_feature: HIJSMM301DWKBH.43.19.B08.1.454.light.4.raw

SEQ ID NO: 563285 - DNA, 491 bp, Homo sapiens; identical to SEQ ID NO: 535176
  misc_feature: HIJSMM301CUD8G.13.39.D06.1.454.light.4.raw

SEQ ID NO: 563286 - DNA, 500 bp, Homo sapiens; identical to SEQ ID NO: 545857
  misc_feature: HIJSMM301CI504.16.86.H09.1.454.light.4.raw

SEQ ID NO: 563287 - DNA, 485 bp, Homo sapiens
  misc_feature: HIJSMM301AG5TL.49.55.E11.1.454.light.4.raw
agtcgagagacacgaccggtgctcgatttagcactcgcacgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagactttgagagggcctcagggacccctgagcgattctctggctccagctcagcgacaacagtcacgttgaccatcagtggagtccgggcagaggacgaggctgactattactgtcagtcatcagacagtatggcacttctgtcgtattcggcggagggaccaagctgaccgtcctaggtcagcccaaggctcg

SEQ ID NO: 563288 - DNA, 447 bp, Homo sapiens
  misc_feature: HIJSMM301DSKLC.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcattctgttcccgccctcctccatactcgta

SEQ ID NO: 563289 - DNA, 499 bp, Homo sapiens; identical to SEQ ID NO: 537739
  misc_feature: HIJSMM301B20CJ.12.86.H09.1.454.light.4.raw

SEQ ID NO: 563290 - DNA, 493 bp, Homo sapiens; identical to SEQ ID NO: 535770
  misc_feature: HIJSMM301D4HY6.51.71.G05.1.454.light.4.raw

SEQ ID NO: 563291 - DNA, 501 bp, Homo sapiens
  misc_feature: HIJSMM301EAWTL.43.77.G11.1.454.light.4.raw
tgtgagtagtcacgaccggtgctcgatttagctagtcactcaagggaaagggggcacaagaggcagcactcaggacagtctccagcatggcctggtcttctctcctcctcactctcctcgctcactgcacagggtcctgggcccagtctgtgctgacgcagccgccctcagtgtctggggccccagggcagagggtcaccatcccctgtactgggagcagtttcaacatcggggcaggtttggatgttaactggtaccagcaacttccaggatcagcccccaaactcctcatctatggtaccaccaatcggccctcaggagtccctgaccgattctctggctccaagtctggcatctcagccttcctggccatcactggactccaggtcgaggatgaggctgattattactgccaggcctgggacatcagcctgagtggccattatgtcttcggaaccgcgaccaaggtcaccggtcctaggtcagcccaaggcccaaccc

SEQ ID NO: 563292 - DNA, 494 bp, Homo sapiens
  misc_feature: HIJSMM301B1K5E.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaactgtggctgcacactctgtctt

SEQ ID NO: 563293 - DNA, 493 bp, Homo sapiens
  misc_feature: HIJSMM301AJP7M.13.39.D06.1.454.light.4.raw
tcacgtactacacgaccggtgctcgatttagtgacatctcgcagttctttggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcacttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtggagatcaaacgaac

SEQ ID NO: 563294 - DNA, 492 bp, Homo sapiens
  misc_feature: HIJSMM301D5KXZ.49.34.D01.1.454.light.4.raw
agtcgagagacacgaccggtgctcgatttagatcgtctgtgttgggtttgggggaggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgggacagacttcactctcaccatcagcagcctagagcctgaagattttgcagtctattactgtcagcagcgttacaactggcctcccatgtacacttttggccaggggaccaagctggaaatcagacgaactgtggctgcaccat

SEQ ID NO: 563295 - DNA, 509 bp, Homo sapiens
  misc_feature: HIJSMM301BFZE6.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtaggacctcaaacgaactgtggctgcaccatctgtcttcatctttcccgccat

SEQ ID NO: 563296 - DNA, 494 bp, Homo sapiens; identical to SEQ ID NO: 535276
  misc_feature: HIJSMM301B2M7L.16.6.A06.1.454.light.4.raw

SEQ ID NO: 563297 - DNA, 499 bp, Homo sapiens
  misc_feature: HIJSMM301DRQUI.17.29.C07.1.454.light.4.raw
cgtagactagcacgaccggtgctcgatttagagtgctacgaagggaaagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcggcggtgggaccaagctgaccgtcctaggtcagcccaaggctgccccccg

SEQ ID NO: 563298 - DNA, 485 bp, Homo sapiens; identical to SEQ ID NO: 536576
  misc_feature: HIJSMM301CAAUR.46.35.D02.1.454.light.4.raw

SEQ ID NO: 563299 - DNA, 509 bp, Homo sapiens; identical to SEQ ID NO: 541829
  misc_feature: HIJSMM301B4G0B.17.28.C06.1.454.light.4.raw

SEQ ID NO: 563300 - DNA, 416 bp, Homo sapiens; identical to SEQ ID NO: 539343
  misc_feature: HIJSMM301CSONV.18.78.H01.1.454.light.4.raw

SEQ ID NO: 563301 - DNA, 506 bp, Homo sapiens
  misc_feature: HIJSMM301BAGK2.19.78.H01.1.454.light.4.raw
tactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccactcgtca

SEQ ID NO: 563302 - DNA, 487 bp, Homo sapiens
  misc_feature: HIJSMM301B1Z6A.11.25.C03.1.454.light.4.raw
cgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaatcccctgctctggaattgaattgagagataaatatacttgttggtatcaacagaagccaggccagtcccctgtattggtcatctatcaagatgtgaagcggccctcagggatccctgagcgattctctggctccaactctgggaacgcagccactctgaccatcagcgggacccaggctatggatgaggctgactattattgtcaggcgtgggacagcagcactgcccgttatgtcttcggaactgggaccaaggtcacgtcttgagtcagcccaaggccaa

SEQ ID NO: 563303 - DNA, 511 bp, Homo sapiens; identical to SEQ ID NO: 537047
  misc_feature: HIJSMM301CY2O4.5.27.C05.1.454.light.4.raw

SEQ ID NO: 563304 - DNA, 524 bp, Homo sapiens
  misc_feature: HIJSMM301B8EZV.27.23.C01.1.454.light.4.raw
agcgtcgtctcacgaccggtgctcgatttagtacacgtgattagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccggggctccagcctgaggacgaggctgattattattgtagttcatatactaaccagtgacacttgggtgttcggcggaggtaccaggctgaccgtcctaggtcagccaaggctgcccctcggcactctgttcccgccctccg

SEQ ID NO: 563305 - DNA, 497 bp, Homo sapiens; identical to SEQ ID NO: 539058
  misc_feature: HIJSMM301BYP82.12.87.H10.1.454.light.4.raw

SEQ ID NO: 563306 - DNA, 509 bp, Homo sapiens; identical to SEQ ID NO: 539359
  misc_feature: HIJSMM301C4YZD.47.85.H08.1.454.light.4.raw

SEQ ID NO: 563307 - DNA, 498 bp, Homo sapiens
  misc_feature: HIJSMM301COPSL.49.18.B07.1.454.light.4.raw
agtcgagagacacgaccggtgctcgatttagtcgctgcgtaagggggaggagctgctcagttaggacccagagggaaccatggaagccccagctcagcttctcttcctcctgctactctggctcccagatatcaccggagaaattgtgttgacgcaatctccagccaccctgtctttgtctccaggggagagagcgaccctctcctgcagggccagtcagaatgttgacaactacttggcctggtaccagcagaagcctggccaggccccccggctcctcatctatgatgcttcaaacagggcccctgacaccccagccaggttcagtggcagtgggtctgggactggcttcactcttaccatcagcagtctcgagcctgaagatcttgcaatttatttctgtcaacagcgcagcaagtggcccctcacttttggccgagggaccaagttggagatcagacgaactgtggctgcaccatctgtcttcatccttccccg

SEQ ID NO: 563308 - DNA, 502 bp, Homo sapiens; identical to SEQ ID NO: 536253
  misc_feature: HIJSMM301B9SVY.21.22.B11.1.454.light.4.raw

SEQ ID NO: 563309 - DNA, 486 bp, Homo sapiens
  misc_feature: HIJSMM301EQDW4.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtgggtcccatcaaggttcagcggcagtgggtctgggacagaattcactctcaccatcagcagcctgcaacctgatgactttgcaacttattactgccaacagtataatggttatgaatccacttttggccaagggccaagctggagatcaaacgaactgtggctgcacc

SEQ ID NO: 563310 - DNA, 485 bp, Homo sapiens
  misc_feature: HIJSMM301AMO9S.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcaccgtctaggtcagcccaaggccaacccc

SEQ ID NO: 563311 - DNA, 494 bp, Homo sapiens; identical to SEQ ID NO: 535276
  misc_feature: HIJSMM301BBQ7Q.16.6.A06.1.454.light.4.raw

SEQ ID NO: 563312 - DNA, 444 bp, Homo sapiens; identical to SEQ ID NO: 535192
  misc_feature: HIJSMM301AMQRH.5.9.A09.1.454.light.4.raw

SEQ ID NO: 563313 - DNA, 476 bp, Homo sapiens
  misc_feature: HIJSMM301DWYWX.8.85.H08.1.454.light.4.raw
ctcgcgtgtccacgaccggtgctcgatttagtatcactcagtcgcgggggagtcagtctcagtcaggacacagcatggacatgagggtccccgctcagctcctggggctcctgctactctggctccgaggtgccagatgtgacatccagatgacccagtctccatcctccctgtctgcatctgtcggagacagagtcaccatcacttgtcgggcaagtcagactataaataattatttaaattggtatcagcagaaaccagggaacgcccctaagctcctcatatattctgcattcactttgcaaagtggggtcccatcaaggttcagtggcagtggatctgggacagatttcactctcaccatccgcagtctgcaacctgaagattttgcaatttattactgtcaagagactcacaatggaggcacttttggccaggggaccaagctggagaggaaacgaactgtgctgcaccat

SEQ ID NO: 563314 - DNA, 518 bp, Homo sapiens
  misc_feature: HIJSMM301A5CQ7.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggccaaccccactgtcactctcg

SEQ ID NO: 563315 - DNA, 500 bp, Homo sapiens; identical to SEQ ID NO: 535310
  misc_feature: HIJSMM301CB3D4.47.66.F11.1.454.light.4.raw

SEQ ID NO: 563316 - DNA, 472 bp, Homo sapiens; identical to SEQ ID NO: 556898
  misc_feature: HIJSMM301AGUD3.13.76.G10.1.454.light.4.raw

SEQ ID NO: 563317 - DNA, 486 bp, Homo sapiens; identical to SEQ ID NO: 535043
  misc_feature: HIJSMM301EKLUT.46.35.D02.1.454.light.4.raw

SEQ ID NO: 563318 - DNA, 498 bp, Homo sapiens; identical to SEQ ID NO: 547576
  misc_feature: HIJSMM301AZX6A.12.37.D04.1.454.light.4.raw

SEQ ID NO: 563319 - DNA, 503 bp, Homo sapiens
  misc_feature: HIJSMM301DE5LE.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtggaaatcaaacgaaactgtggctgcaccatctgtcttcatcttccccg

SEQ ID NO: 563320 - DNA, 502 bp, Homo sapiens
  misc_feature: HIJSMM301BKWZ4.18.59.F04.1.454.light.4.raw
tacgagtatgcacgaccggtgctcgatttagtacacacacttagggattgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaacccactgt

SEQ ID NO: 563321 - DNA, 484 bp, Homo sapiens
  misc_feature: HIJSMM301DYQO2.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgaggattttgcaacttattactgtctacaagattacacttaccctgggacgttcggccaagggaccaaggtggaaagtacaaacgaactagtggctgcaccta

SEQ ID NO: 563322 - DNA, 444 bp, Homo sapiens; identical to SEQ ID NO: 535594
  misc_feature: HIJSMM301BYNX0.9.9.A09.1.454.light.4.raw

SEQ ID NO: 563323 - DNA, 487 bp, Homo sapiens; identical to SEQ ID NO: 541729
  misc_feature: HIJSMM301CRU7T.40.83.H06.1.454.light.4.raw

SEQ ID NO: 563324 - DNA, 485 bp, Homo sapiens; identical to SEQ ID NO: 535880
  misc_feature: HIJSMM301C2SSD.7.75.G09.1.454.light.4.raw

SEQ ID NO: 563325 - DNA, 489 bp, Homo sapiens
  misc_feature: HIJSMM301CCTNW.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcacttcgtcggaggaccgaagcggaggatcagacgaactgtggctgcaccactctgtcttcta

SEQ ID NO: 563326 - DNA, 488 bp, Homo sapiens; identical to SEQ ID NO: 537260
  misc_feature: HIJSMM301E0R69.47.70.G04.1.454.light.4.raw

SEQ ID NO: 563327 - DNA, 481 bp, Homo sapiens
  misc_feature: HIJSMM301DJQLU.4.1.A01.1.454.light.4.raw
agcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtctccaggggagagagccaccctctcctgcagggccaatcagagtattggtcacagcttagcctggtaccagcagaaacctggccaggctcccggtctcctcatctctgctgcgtccatcagggccactggtatccctgccaggttccgtggcagtgggtctgggacagagttcactctcaccatcagcagcctgcagtctgatgatgttgcagtttattactgtcatcaatatggtgaccggcccacgttcggccaagggaccaaggtggaaatcaaacgactgtggctgcaccatctgtcttc

SEQ ID NO: 563328 - DNA, 490 bp, Homo sapiens
  misc_feature: HIJSMM301BGOLB.5.47.E03.1.454.light.4.raw
atcagacacgcacgaccggtgctcgatttagactcgcgcacagagagaagggggaagagctgctcagttaggacccagagggaaccatggaaaccccagcgcagcatctcttcctcctgctactctggctcccagataccgccggagaaattgtgttgacgcagtctccaggcaccctgtctttgtctccaggagaaagagccaccctctcctgcagggccagtcagagtgttagcggcgactacttagcctggtaccagcagaaacctggccagactcccaggctcctcatctttggtgtatccagcagggccactggcatcccacgtaggttcagtggcagtgggtctgggacagacttcactctcaccatcagcagactggagcctgaagattttgcagtgtattactgtcagcagtatgggctctcacctttcactttcggcggagggaccaaggtggagaacaaacgaactagtggctgcaccat

SEQ ID NO: 563329 - DNA, 481 bp, Homo sapiens
  misc_feature: HIJSMM301DGPYM.21.87.H10.1.454.light.4.raw
tcgtcgctcgcacgaccggtgctcgatttagcagtactgcgttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggttttggctgttcggcggcgggacc

SEQ ID NO: 563330 - DNA, 489 bp, Homo sapiens; identical to SEQ ID NO: 537328
  misc_feature: HIJSMM301BBNZM.13.5.A05.1.454.light.4.raw

SEQ ID NO: 563331 - DNA, 471 bp, Homo sapiens
  misc_feature: HIJSMM301CTCG8.17.39.D06.1.454.light.4.raw
cgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttggcagcaacttagcctggtatcagcagaaacctggccaggctcccaggctcctcatgtatggtgcatctaccagggccactggtgtcccagccaggttcagtggcaggtgggtctgggacagagttctctctcatcatcagcagcctgcagtctgaagtattttgcggtttatactgtcagcagtataatcagtggcctcgtggacgttcggcaggaccaggtagaatcaagactgtg

SEQ ID NO: 563332 - DNA, 516 bp, Homo sapiens
  misc_feature: HIJSMM301ECON0.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctagaagatgtggctagtttattactgtcaactagttttcgcgggtcgttcggccgaacgggaccgaaggtaggaaagtacaaacgaactggtggctgcaccatctgtcttcacttccttccccg

SEQ ID NO: 563333 - DNA, 495 bp, Homo sapiens
  misc_feature: HIJSMM301A9VNN.40.83.H06.1.454.light.4.raw
tctagcgactcacgaccggtgctcgatttagatcacgtgcgtcgcggggtctccaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgacccatcactggactcaagcctgaggacggaggctgactattactgttcagcagtgggacgcacgcctcagtagaagtgggtgttcggcgggagggaccaaacgtcgtccgtccgtaggtcaccg

SEQ ID NO: 563334 - DNA, 479 bp, Homo sapiens
  misc_feature: HIJSMM301CRW6F.3.88.H11.1.454.light.4.raw
  modified_base (412)..(412): a, c, t, g, unknown or other
agacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccactttgcaaactggggtcccatccaggttcagcggcaggggagtctgggacagatttcactctcaccatcagcagcctgcagcctgaagatttgtcaacttactattgtntacaggctaacagttcctttacttacttcgtccgacggaagacgacgacgtaggagtaaataaaccg

SEQ ID NO: 563335 - DNA, 503 bp, Homo sapiens; identical to SEQ ID NO: 538884
  misc_feature: HIJSMM301BEVNW.27.78.H01.1.454.light.4.raw

SEQ ID NO: 563336 - DNA, 499 bp, Homo sapiens; identical to SEQ ID NO: 536578
  misc_feature: HIJSMM301EUR36.22.27.C05.1.454.light.4.raw

SEQ ID NO: 563337 - DNA, 487 bp, Homo sapiens; identical to SEQ ID NO: 555619
  misc_feature: HIJSMM301ANKF9.46.35.D02.1.454.light.4.raw

SEQ ID NO: 563338 - DNA, 505 bp, Homo sapiens
  misc_feature: HIJSMM301AZNKY.17.27.C05.1.454.light.4.raw
cgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtcatttatggtaagaataaccggccctcagggatcccagaccgattctctggctccgactcaggaaagacagcttccctgaccatcactggggctcaggcggaagatgaggctgactattactgtaacgtcccgggaccagcagtgctgacccaggtggtattcggcgggagggacccacctgaccgtcttaggtcagcccaaggctgccccctccggtc

SEQ ID NO: 563339 - DNA, 480 bp, Homo sapiens
  misc_feature: HIJSMM301CKMQR.7.76.G10.1.454.light.4.raw
cgtgtctctacacgaccggtgctcgatttagtcactcatacagggggcaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagcccctaaactcctgatctctgctgcatccagtttacaaagtggggtcccatcgcggttcagcggcagtggatatgggacatatttcactctcgccatcagcagcctgcagcctgaagattttgcaacttactattgtcaacaggctaacagtttcccgctcaccttcggcgggggaccgaaggtggagatcaaacgaaactgtggctgcacc

SEQ ID NO: 563340 - DNA, 486 bp, Homo sapiens; identical to SEQ ID NO: 535043
  misc_feature: HIJSMM301B8E8M.46.35.D02.1.454.light.4.raw

SEQ ID NO: 563341 - DNA, 504 bp, Homo sapiens; identical to SEQ ID NO: 539091
  misc_feature: HIJSMM301CG9SB.8.28.C06.1.454.light.4.raw

SEQ ID NO: 563342 - DNA, 505 bp, Homo sapiens; identical to SEQ ID NO: 549187
  misc_feature: HIJSMM301DTV51.12.53.E09.1.454.light.4.raw

SEQ ID NO: 563343 - DNA, 497 bp, Homo sapiens
  misc_feature: HIJSMM301BNXH9.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccggcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaactgtggctgcaccatctgtcttcta

SEQ ID NO: 563344 - DNA, 507 bp, Homo sapiens
  misc_feature: HIJSMM301EO8T8.3.79.H02.1.454.light.4.raw
agacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgattttttatatctctgtctcctggtaccaacaacacccaggcaaagcccccaaactcatcatttatgatgtcactgctcggccctcaggggtttctcatcgcttttctggctccaagtctggcaccacggcctccctgaccatctcggggctccaggctgaggacgaggctgcttattactgcagctcatatacaaggagcaccactctcgtggtatttggtggagggaccaagctgaccgtcctaggtcagcccaaggctgccccctcggt

SEQ ID NO: 563345 - DNA, 482 bp, Homo sapiens
  misc_feature: HIJSMM301EHY1G.19.5.A05.1.454.light.4.raw
tactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtattttgtacagacccaacagtaagaactacttggcttggtatcagcagaaaccaggacagcctcctaaactgctcatttattgggcatctacccgggaaattggggtccctgtccgattcagcggcagcgtgtctgggacagatttcactctcaccatcagcagcctgcaggctgaagatgtggcggtctattactgtcaacaatattatgaaagtccagggacttcggccctgggactaaggtggagatcagacgaactgtggctgcaccatctgtcttc

SEQ ID NO: 563346 - DNA, 521 bp, Homo sapiens; identical to SEQ ID NO: 538715
  misc_feature: HIJSMM301BGQE7.27.23.C01.1.454.light.4.raw

SEQ ID NO: 563347 - DNA, 496 bp, Homo sapiens; identical to SEQ ID NO: 537925
  misc_feature: HIJSMM301C70EJ.22.14.B03.1.454.light.4.raw

SEQ ID NO: 563348 - DNA, 508 bp, Homo sapiens; identical to SEQ ID NO: 541908
  misc_feature: HIJSMM301EINO3.47.85.H08.1.454.light.4.raw

SEQ ID NO: 563349 - DNA, 503 bp, Homo sapiens
  misc_feature: HIJSMM301CEWR7.10.65.F10.1.454.light.4.raw
catagtagtgcacgaccggtgctcgatttagctacgctctaagggggcaggagtcagtctcagtcaggacacagcatggacatgagggtccccgctcagctcctggggctcctgctactctggctccgaggtgccagatgtgacatccagatgacccagtctccaccgtccctgtctgcatttgttggagacagagtcaccatctcttgccggacaagtcagaacattgacacctatttgaattggtatcaacaaaaactggggaaagcccctacactcctgatcaatgcagcgtccagtttacagagtggggtcccctcaaggttcagtggcagtggatctgggacagactttactctcaccatcagcgatctgcagcctgacgattttgcgacttactactgtcaacagagtttccggaaccccgttactttcggtcggagggaccgaaggtggagatcaaacgaactagtggctgcaccactctgtcttcatcttccccg

SEQ ID NO: 563350 - DNA, 485 bp, Homo sapiens; identical to SEQ ID NO: 536210
  misc_feature: HIJSMM301EHHSU.43.54.E10.1.454.light.4.raw

SEQ ID NO: 563351 - DNA, 485 bp, Homo sapiens; identical to SEQ ID NO: 535501
  misc_feature: HIJSMM301CW4JD.3.10.A10.1.454.light.4.raw

SEQ ID NO: 563352 - DNA, 445 bp, Homo sapiens; identical to SEQ ID NO: 542143
  misc_feature: HIJSMM301AN2ZY.47.85.H08.1.454.light.4.raw

SEQ ID NO: 563353 - DNA, 489 bp, Homo sapiens; identical to SEQ ID NO: 546884
  misc_feature: HIJSMM301CJVD4.14.55.E11.1.454.light.4.raw

SEQ ID NO: 563354 - DNA, 498 bp, Homo sapiens
  misc_feature: HIJSMM301EJA4J.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcggcccaagggaccaaggtggaaatcaaacgaactgtggctgcacca

SEQ ID NO: 563355 - DNA, 480 bp, Homo sapiens; identical to SEQ ID NO: 535291
  misc_feature: HIJSMM301AGTNM.22.59.F04.1.454.light.4.raw

SEQ ID NO: 563356 - DNA, 487 bp, Homo sapiens
  misc_feature: HIJSMM301BDX9B.40.35.D02.1.454.light.4.raw
tctagcgactcacgaccggtgctcgatttagcacacgatagttgggtttgggcacgaccggtgctcgatttagctcgatatagttgggtttgggggctggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttatttttgctgctcttatgcaggcagtttcgct

SEQ ID NO: 563357 - DNA, 498 bp, Homo sapiens; identical to SEQ ID NO: 535295
  misc_feature: HIJSMM301D34YV.15.25.C03.1.454.light.4.raw

SEQ ID NO: 563358 - DNA, 507 bp, Homo sapiens
  misc_feature: HIJSMM301AW02U.5.24.C02.1.454.light.4.raw
atcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaaggctgaccgtcctaggtcagcccaaggctgccccccg

SEQ ID NO: 563359 - DNA, 502 bp, Homo sapiens; identical to SEQ ID NO: 541910
  misc_feature: HIJSMM301AQTE8.11.31.C09.1.454.light.4.raw

SEQ ID NO: 563360 - DNA, 490 bp, Homo sapiens; identical to SEQ ID NO: 535936
  misc_feature: HIJSMM301AL1GT.16.68.G02.1.454.light.4.raw

SEQ ID NO: 563361 - DNA, 509 bp, Homo sapiens
  misc_feature: HIJSMM301CQV6Z.5.60.F05.1.454.light.4.raw
atcagacacgcacgaccggtgctcgatttagtacgtcatcagggaaagggggcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctggaagcacctccaacatcggaagtaatattgtaaactggtaccagcagctcccaggaacggcccccaaactcctcatctataggaataatcaacggccctcaggggtccctgaccgattctctggctccaagtctggcacctcagcctccctggccatccgtgggctccagtctgaggatgagtctgattattactgtgcaacatgggatgacagcctgaatggtccggtattcggcggagggaccaagctgaccgtcctcggtcagcccaaggctgccccctggt

SEQ ID NO: 563362 - DNA, 521 bp, Homo sapiens
  misc_feature: HIJSMM301AJY0K.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccaacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccgccct

SEQ ID NO: 563363 - DNA, 496 bp, Homo sapiens; identical to SEQ ID NO: 535541
  misc_feature: HIJSMM301C7PMZ.3.33.C11.1.454.light.4.raw

SEQ ID NO: 563364 - DNA, 507 bp, Homo sapiens; identical to SEQ ID NO: 539082
  misc_feature: HIJSMM301C5SVK.14.7.A07.1.454.light.4.raw

SEQ ID NO: 563365 - DNA, 497 bp, Homo sapiens
  misc_feature: HIJSMM301DDJDB.9.71.G05.1.454.light.4.raw
tgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcggagggaccaggctgaccgtcctgagtcagcccaaggctcg

SEQ ID NO: 563366 - DNA, 377 bp, Homo sapiens; identical to SEQ ID NO: 536071
  misc_feature: HIJSMM301DQFCC.40.9.A09.1.454.light.4.raw

SEQ ID NO: 563367 - DNA, 498 bp, Homo sapiens
  misc_feature: HIJSMM301CX7S9.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgtttcggccaagggaccaaggtggaaatcaaacgaactgtggctgcacca

SEQ ID NO: 563368 - DNA, 509 bp, Homo sapiens; identical to SEQ ID NO: 536339
  misc_feature: HIJSMM301D92HK.17.33.C11.1.454.light.4.raw

SEQ ID NO: 563369 - DNA, 489 bp, Homo sapiens
  misc_feature: HIJSMM301B8AH5.16.73.G07.1.454.light.4.raw
tgtactactccacgaccggtgctcgatttagctctacgctcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcaacaatattataataatccatttaatttcggcggagggaccaaggtggagatcaaacgactgtggctgcaccatctgtcttcatcttcccgcc

SEQ ID NO: 563370 - DNA, 454 bp, Homo sapiens; identical to SEQ ID NO: 535005
  misc_feature: HIJSMM301CQKS0.19.86.H09.1.454.light.4.raw

SEQ ID NO: 563371 - DNA, 466 bp, Homo sapiens; identical to SEQ ID NO: 535366
  misc_feature: HIJSMM301D89RJ.13.4.A04.1.454.light.4.raw

SEQ ID NO: 563372 - DNA, 498 bp, Homo sapiens; identical to SEQ ID NO: 544540
  misc_feature: HIJSMM301B3DMP.41.20.B09.1.454.light.4.raw

SEQ ID NO: 563373 - DNA, 497 bp, Homo sapiens
  misc_feature: HIJSMM301BSBO6.11.25.C03.1.454.light.4.raw
cgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccacctcagtgtccgtgtccccaggacagacagccagaatcccctgctctggaattgaattgagagataaatatacttgttggtatcaacagaagccaggccagtcccctgtattggtcatctatcaagatgtgaagcggccctcagggatccctgagcgattctctggctccaactctgggaacgcagtccactctgaccatcagcgggacccaggctatggatgaggctgactattatgtcaggcgtgggacagcagcactcgtccgttatgtctacggacttcgggacaaggtcaccgttcttgagtcacgccaacggccctaaccccg

SEQ ID NO: 563374 - DNA, 514 bp, Homo sapiens; identical to SEQ ID NO: 538153
  misc_feature: HIJSMM301DNTI7.17.37.D04.1.454.light.4.raw

SEQ ID NO: 563375 - DNA, 504 bp, Homo sapiens
  misc_feature: HIJSMM301DWKCD.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaagtcagcccaaggctgccccctcggtcta

SEQ ID NO: 563376 - DNA, 505 bp, Homo sapiens; identical to SEQ ID NO: 551816
  misc_feature: HIJSMM301BDK2R.18.78.H01.1.454.light.4.raw

SEQ ID NO: 563377 - DNA, 501 bp, Homo sapiens
  misc_feature: HIJSMM301C4V48.40.42.D09.1.454.light.4.raw
tctagcgactcacgaccggtgctcgatttagacacatacgcagggaaagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagaagcattgccaaaaaaatatgcttattggtaccaacagaagtcaggccaggcccctgtgctggtcatctatgaggacaacaaacgaccctccgagatccctgagagattctctggctccagctcagggacaatggccaccttggctctcagtggggcccaggtggaggatgaagctgactactactgttactcagtggacagcagtggaaatcatggggtattcggcggagggaccaagctgaccgtcctaggtcagcccaaggctgccccctcggtctac

SEQ ID NO: 563378 - DNA, 501 bp, Homo sapiens; identical to SEQ ID NO: 535746
  misc_feature: HIJSMM301CGCWV.18.11.A11.1.454.light.4.raw

SEQ ID NO: 563379 - DNA, 469 bp, Homo sapiens
  misc_feature: HIJSMM301BH015.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctcctccgagtgccacttttgcgggggaccaaggtggacatcaacgaa

SEQ ID NO: 563380 - DNA, 514 bp, Homo sapiens
  misc_feature: HIJSMM301D3WSS.22.30.C08.1.454.light.4.raw
acatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggctgccccctcggtcactctgttcccaccctcctc

SEQ ID NO: 563381 - DNA, 507 bp, Homo sapiens
  misc_feature: HIJSMM301CKU6U.16.46.E02.1.454.light.4.raw
tgtactactccacgaccggtgctcgatttagactcatctacagggaaagggggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggcccaacccactgtcact

SEQ ID NO: 563382 - DNA, 485 bp, Homo sapiens
  misc_feature: HIJSMM301D1P0K.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccacgtggcatcccaggcagattcagtggcagtgggtctgggacagacttcactctcaccatcagcagactggagcctgaagattttgcagtctattactgtcagcagtatggtcacgtcccaagaactttggccaggggaccaagctggagatcaacgaactgtggctgcaccat

SEQ ID NO: 563383 - DNA, 503 bp, Homo sapiens
  misc_feature: HIJSMM301B8XNJ.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctggaccaaagtggatatcaaacgaactgtggctgcacactctgtt

SEQ ID NO: 563384 - DNA, 509 bp, Homo sapiens
  misc_feature: HIJSMM301BA7BK.17.33.C11.1.454.light.4.raw
cgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctggtcactctgttcccta

SEQ ID NO: 563385 - DNA, 515 bp, Homo sapiens
  misc_feature: HIJSMM301EOG53.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctactgactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtgttcggcggagggaccaagctggccgtcctaggtcagcccaaggctgccccctcggtcacttctgttccccaccctctcgagtagtaca

SEQ ID NO: 563386 - DNA, 504 bp, Homo sapiens
  misc_feature: HIJSMM301BNZ0H.4.57.F02.1.454.light.4.raw
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgcttctctggatccaactctgggaacacagccactctgaccatcagcgggacccaacttttagatgaggccgactattctgtcacacgtgggacatgggcactgcgatcttcggcggagggaccaagctgaccgtcctgggtcagcccaaggctgccccctcggtcactctgttccccg

SEQ ID NO: 563387 - DNA, 485 bp, Homo sapiens; identical to SEQ ID NO: 548503
  misc_feature: HIJSMM301EPO0L.48.53.E09.1.454.light.4.raw

SEQ ID NO: 563388 - DNA, 485 bp, Homo sapiens; identical to SEQ ID NO: 536263
  misc_feature: HIJSMM301BYR9T.47.78.H01.1.454.light.4.raw

SEQ ID NO: 563389 - DNA, 478 bp, Homo sapiens
  misc_feature: HIJSMM301E08DX.5.73.G07.1.454.light.4.raw
atcagacacgcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccgccctgtctgtgtctccaggggaaagagcctccctctcgtgcagggccagtcagagtgttagaatcaacttagcctggtaccagcagaaacctggccagcctcccaggcccctcatctatgctgcatccgccagggccactggtatcccagccaggttcagtggcagtgggtctgggacagacttcactctcaccatcagcagcctgcagtctgaagattttgcagtttattactgtcagcagtatgatgactggcctcagacgttcggccaagggaccaaggtggaagtcaaacgaactgtggctgcacat

SEQ ID NO: 563390 - DNA, 478 bp, Homo sapiens; identical to SEQ ID NO: 555324
  misc_feature: HIJSMM301CQHE6.13.59.F04.1.454.light.4.raw

SEQ ID NO: 563391 - DNA, 499 bp, Homo sapiens
  misc_feature: HIJSMM301BY5SI.7.5.A05.1.454.light.4.raw
cgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggtttccgtaatcgcttctctggctccaagtctggcgacacggcctccctgaccatctctggctccaggctgaagacgaggctgattattactgcagctcatatacaggcagcagcactcaggttttcggcgggagggaccaagctgaccggtcctaggtcagcccaaggctgccccctcggt

SEQ ID NO: 563392 - DNA, 481 bp, Homo sapiens; identical to SEQ ID NO: 535993
  misc_feature: HIJSMM301B1YTX.21.25.C03.1.454.light.4.raw

SEQ ID NO: 563393 - DNA, 489 bp, Homo sapiens; identical to SEQ ID NO: 536663
  misc_feature: HIJSMM301ATVIO.16.72.G06.1.454.light.4.raw

SEQ ID NO: 563394 - DNA, 521 bp, Homo sapiens; identical to SEQ ID NO: 538715
  misc_feature: HIJSMM301BQJ8R.27.23.C01.1.454.light.4.raw

SEQ ID NO: 563395 - DNA, 482 bp, Homo sapiens
  misc_feature: HIJSMM301DMPUT.12.10.A10.1.454.light.4.raw
atacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggccagtcaggacattagcaatttatttaggctggtatcagcagaagccagggaaagcccctaacgtcctgatctatggtgcatccactttgcataggtggggtcccatcaaggttcagcggcagtggatctgggacagaattcactctcacaatcaccagcctgcagcctgaagattttgcaacttattactgtcaacaggtttatatttaccctcgttattttcggccctgggaccacagtagatatcaaacgaactgtggctgcacc

SEQ ID NO: 563396 - DNA, 510 bp, Homo sapiens
  misc_feature: HIJSMM301C373L.43.67.G01.1.454.light.4.raw
tgtgagtagtcacgaccggtgctcgatttagagtatacatattgggtttgggggagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgttatactccgccgacgttcggccggggaccgaccgtggaaatacaaacgaaactgtggctgcaccatctgtctt

SEQ ID NO: 563397 - DNA, 491 bp, Homo sapiens
  misc_feature: HIJSMM301AFXNX.41.44.D11.1.454.light.4.raw
tctatactatcacgaccggtgctcgatttagcgcagtacgaagggggcgggggtaagaggttgtgtccaccatggcctggactcctctcctcctcctgttcctctctcactgcacaggttccctctcgcaggctgtgctgactcagccgtcttccctctctgcatctcctggagcatcagtcagtctcacctgcaccttgcgcagtggcatcgatgttaataggtacacgatatattggtaccagaggaggccagggagtcctccccaatttctcctgagctacaagtcacagtcagatacacagcggggctctggagtccccagacgcttctctggattcaaagatgtttcggccaatgcaggcattttagtcatctctggggtccagtttgtggatgaggctgactactattgcacggtctggtacagcagcgctgtggtcttcggcggagggactgaacttatcgtcctaggtcagcccaaggctccg

SEQ ID NO: 563398 - DNA, 503 bp, Homo sapiens
  misc_feature: HIJSMM301CHLKR.48.87.H10.1.454.light.4.raw
agtatacatacacgaccggtgctcgatttagcagtactgcgttgggtttggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgactggtggctgcaccatctgtcttcatcttccccg

SEQ ID NO: 563399 - DNA, 454 bp, Homo sapiens; identical to SEQ ID NO: 536846
  misc_feature: HIJSMM301CX5AJ.18.78.H01.1.454.light.4.raw

SEQ ID NO: 563400 - DNA, 536 bp, Homo sapiens
  misc_feature: HIJSMM301BT1H3.16.1.A01.1.454.light.4.raw
tgtactactccacgaccggtgctcgatttagacgtctcatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctcctgaccgtctctggcctccagactgaggacgaggctgattattactgccactcatatagaagtagtacttacctcgtgttggtttcggcgggacggaccagctcgtaccgtccgttagtcgaccgaccgaacggtcgtcccgtcccccggtccggtacctaccttcttccgtta

SEQ ID NO: 563401 - DNA, 508 bp, Homo sapiens
  misc_feature: HIJSMM301BYSHA.2.21.B10.1.454.light.4.raw
acgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaggacaggcccctgtaattgtcatctatggaatctatggtaaaaacaaccggccctcagggatcccagaccgattctctggctcctactcaggaaacacagcttccttggccatcactggggctcaggcggaagatgaggctgactattattgtaagtccggggacagaagtggtaattacatggtgttcggcggagggaccaagctgaccgtcctacgtcagcccaaggctgccccctcggtcactctcg

SEQ ID NO: 563402 - DNA, 468 bp, Homo sapiens
  misc_feature: HIJSMM301AGZ7T.49.28.C06.1.454.light.4.raw
agtcgagagacacgaccggtgctcgatttagagctcacgtattgggtttggggagtcagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcatcacctactatttaaattggtatcagcaaaacccagggaaagcccctaagctcctgatctatgctgcatccaatctgcaaagtggggtcccatcaaggttcagtggcagtggatctgggacagatttcaccctcaccatcagcagtctgcaacctgatgattttgcaacttattattgtcaacagagttacagtatcccgtacacttttggtccagggaccaggctggatatcagacgaa

SEQ ID NO: 563403 - DNA, 490 bp, Homo sapiens; identical to SEQ ID NO: 535526
  misc_feature: HIJSMM301ECB50.26.78.H01.1.454.light.4.raw

SEQ ID NO: 563404 - DNA, 510 bp, Homo sapiens
  misc_feature: HIJSMM301C2KY9.51.41.D08.1.454.light.4.raw
  modified_base (438)..(438): a, c, t, g, unknown or other
cgatcgtatacacgaccggtgctcgatttagtcacgcgagaaagggaaagggggatcaggactcctcagttcaccttctcacaatgaggctccctgctcagctcctggggctgctaatgctctgggtcccagcatccagtggagatgttgtgctgactcagtctccactctccctgtccgtcacccttggacagccagcttccatctcctgcaggtctagtcaaagcctcgtttatagtgttggaaacacctacttgaattggtttcatcagaggccgggccaaatctccaaggcgcctgatttataaaggtttctaaccgggactctggggtcccagacagattcagcggcagtgggtcaaggcactcatttcacactgaggatcagcagggtggaggctgaggatgttggggtttattactgcatgcaaggtacanactggcctcctaactcaccttcgccgaaggacgacgaactgaggttaaacgaaactaagtggctgcaccata

SEQ ID NO: 563405 - DNA, 488 bp, Homo sapiens; identical to SEQ ID NO: 535990
  misc_feature: HIJSMM301CCIWX.11.28.C06.1.454.light.4.raw

SEQ ID NO: 563406 - DNA, 463 bp, Homo sapiens; identical to SEQ ID NO: 535062
  misc_feature: HIJSMM301BXWT7.11.73.G07.1.454.light.4.raw

SEQ ID NO: 563407 - DNA, 521 bp, Homo sapiens; identical to SEQ ID NO: 538715
  misc_feature: HIJSMM301AE386.27.23.C01.1.454.light.4.raw

SEQ ID NO: 563408 - DNA, 497 bp, Homo sapiens
  misc_feature: HIJSMM301ATOXX.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgaggaggccaccagtcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatattttcgtgctccgtacacttttggccaggggaccccaggtggagatcagacgaactgtggctgcaccatctgtcttcatcttcccg

SEQ ID NO: 563409 - DNA, 477 bp, Homo sapiens
  misc_feature: HIJSMM301CM93L.12.1.A01.1.454.light.4.raw
atacgacgtacacgaccggtgctcgatttagacgtctcatcagggcacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaaggttcagtggcagtgggtctgggacagatttcactctcaccatcagcagtctgcaacctgaagattctgcaacttattactgtcaacagagtaacagttaccctccactttcggcggagggaccaaggtggagatcaaacgaactgtggctgcaccatctgtcttcatcttcccgccta

SEQ ID NO: 563410 - DNA, 483 bp, Homo sapiens
  misc_feature: HIJSMM301D7F98.46.26.C04.1.454.light.4.raw
  modified_base (458)..(458): a, c, t, g, unknown or other
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctatattgcatgcaagctctacaagtcccgctcactttcggcggngggaccaaggtggagatcaaacgaa

SEQ ID NO: 563411 - DNA, 485 bp, Homo sapiens; identical to SEQ ID NO: 539576
  misc_feature: HIJSMM301D7TPW.4.57.F02.1.454.light.4.raw

SEQ ID NO: 563412 - DNA, 502 bp, Homo sapiens; identical to SEQ ID NO: 554531
  misc_feature: HIJSMM301C0YYS.21.81.H04.1.454.light.4.raw

SEQ ID NO: 563413 - DNA, 501 bp, Homo sapiens; identical to SEQ ID NO: 537793
  misc_feature: HIJSMM301C5E72.15.37.D04.1.454.light.4.raw

SEQ ID NO: 563414 - DNA, 487 bp, Homo sapiens; identical to SEQ ID NO: 541583
  misc_feature: HIJSMM301B68GD.41.57.F02.1.454.light.4.raw

SEQ ID NO: 563415 - DNA, 499 bp, Homo sapiens; identical to SEQ ID NO: 555664
  misc_feature: HIJSMM301ER0ND.40.42.D09.1.454.light.4.raw

SEQ ID NO: 563416 - DNA, 489 bp, Homo sapiens; identical to SEQ ID NO: 536663
  misc_feature: HIJSMM301EN2A3.16.72.G06.1.454.light.4.raw

SEQ ID NO: 563417 - DNA, 467 bp, Homo sapiens
  misc_feature: HIJSMM301ESSN6.41.48.E04.1.454.light.4.raw
tctatactatcacgaccggtgctcgatttagagagcgtcacagagagaaggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtggacatcagcagtgaggtggttttcggcggagggaccgaagctgaccgtcct

SEQ ID NO: 563418 - DNA, 513 bp, Homo sapiens
  misc_feature: HIJSMM301CYQHE.9.12.B01.1.454.light.4.raw
tgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttatacggctccgacaacaagaactacttagcttggtatcagcagaaaccaggacagcctcctaaactgctcattaactgggcatctacccggcaactccggggtccctgaccgattcagtggcagcgggtctgggacagatttcactctcaccatcagcagcctgcaggctgaagatgtggcagtttattactgtcaactagttttctcgggtcgttcggtccgaacgggaccgaaggtaggaaagtacaaaacgaaactacgtggcgtgcaccaa

SEQ ID NO: 563419 - DNA, 513 bp, Homo sapiens
  misc_feature: HIJSMM301DG02O.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctggggacttcgttcactctcaccatcaataacctgcaatctgacgactttgcagtttatttctgtcagcagtctgaagactggccgttcactttcggtcggagggaccgaaggtggaccgtcaaacgaactagtggctgcaccatctgtcttcatcttcccgccact

SEQ ID NO: 563420 - DNA, 501 bp, Homo sapiens; identical to SEQ ID NO: 548482
  misc_feature: HIJSMM301B06QQ.41.71.G05.1.454.light.4.raw

SEQ ID NO: 563421 - DNA, 454 bp, Homo sapiens; identical to SEQ ID NO: 536846
  misc_feature: HIJSMM301AOQHL.18.78.H01.1.454.light.4.raw

SEQ ID NO: 563422 - DNA, 499 bp, Homo sapiens
  misc_feature: HIJSMM301ES9XV.9.12.B01.1.454.light.4.raw
  modified_base (463)..(463): a, c, t, g, unknown or other
  modified_base (489)..(489): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttgccaaggaccgaaggtaggaaagtanaaacgaactagtaggctgcaccaatntcgtcttcta

SEQ ID NO: 563423 - DNA, 510 bp, Homo sapiens
  misc_feature: HIJSMM301AU2MX.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaacgggaccaaggtggaaagtacaaacgaaacctagtggcgtgcaccatctgtcttctatcttccccg

SEQ ID NO: 563424 - DNA, 503 bp, Homo sapiens; identical to SEQ ID NO: 551625
  misc_feature: HIJSMM301CHKT9.10.71.G05.1.454.light.4.raw

SEQ ID NO: 563425 - DNA, 491 bp, Homo sapiens
  misc_feature: HIJSMM301AEE6V.43.82.H05.1.454.light.4.raw
tgtgagtagtcacgaccggtgctcgatttagtcgagctctctcgcggggcagcttcagctgtgggtagagaagacaggactcaggacaatctccagcatggccagcttccctctcctcctcgccctcctcactcactgtgcagggtcctgggcccagtctgtcctgactcagccaccctcagcgtctgggacccccgggcagagggtcaccatctcttgttctggaagcagctccaacatcggaagtaatactgtaaactggtaccagcagctcccaggaacggcccccaaactcctcatctacagtattaatcagcggccctcagggatccctgaccgattctctggctccaagtctggcgcctcagcctccctggccatcagtgggctccagtctgaggatgaggctgattattactgtgctgcatgggatgacagcctgaatgcttgggtgttcggcggagggaccaagctgaccgtcctaggtcacg

SEQ ID NO: 563426 - DNA, 485 bp, Homo sapiens
  misc_feature: HIJSMM301AUP2R.19.71.G05.1.454.light.4.raw
tactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggtccaagggaccgaaggtggagtatcagacgaa

SEQ ID NO: 563427 - DNA, 484 bp, Homo sapiens; identical to SEQ ID NO: 535400
  misc_feature: HIJSMM301C7I5H.46.26.C04.1.454.light.4.raw

SEQ ID NO: 563428 - DNA, 514 bp, Homo sapiens
  misc_feature: HIJSMM301DWAFP.16.46.E02.1.454.light.4.raw
tgtactactccacgaccggtgctcgatttagactcatctacaggggaaaggggggagtctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacacgcccccaaacctcatgatttatgaagtcagtaatcggccctcaggggtccctgatcgcttctctgggtccaagtctggcaacacggcctccctgaccatctctggctccaggctgaggacgaggctgattattactgcagcttatatacaggcaacaatacttttgtcttcggaactggaccaaggtcaccgtcctaggtcagcccaaggccaaccccactgtcactcttccg

SEQ ID NO: 563429 - DNA, 506 bp, Homo sapiens
  misc_feature: HIJSMM301DI2MA.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcggataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccggggccacttcggccctgggaccaaggtggagatcaaacgaactgtggctgcaccatctgtcttcat

SEQ ID NO: 563430 - DNA, 496 bp, Homo sapiens; identical to SEQ ID NO: 536248
  misc_feature: HIJSMM301EXY19.22.27.C05.1.454.light.4.raw

SEQ ID NO: 563431 - DNA, 483 bp, Homo sapiens; identical to SEQ ID NO: 539848
  misc_feature: HIJSMM301AINKH.46.26.C04.1.454.light.4.raw

SEQ ID NO: 563432 - DNA, 483 bp, Homo sapiens; identical to SEQ ID NO: 538138
  misc_feature: HIJSMM301AT7CV.41.34.D01.1.454.light.4.raw

SEQ ID NO: 563433 - DNA, 504 bp, Homo sapiens; identical to SEQ ID NO: 550923
  misc_feature: HIJSMM301BQOR0.51.2.A02.1.454.light.4.raw

SEQ ID NO: 563434 - DNA, 496 bp, Homo sapiens; identical to SEQ ID NO: 537925
  misc_feature: HIJSMM301B46XA.22.14.B03.1.454.light.4.raw

SEQ ID NO: 563435 - DNA, 493 bp, Homo sapiens
  misc_feature: HIJSMM301A1UGM.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggtcggagggaccgaaggacggagatcagacgaactgtggctgcaccactctgtcttcta

SEQ ID NO: 563436 - DNA, 447 bp, Homo sapiens; identical to SEQ ID NO: 535020
  misc_feature: HIJSMM301BMHS5.18.9.A09.1.454.light.4.raw

SEQ ID NO: 563437 - DNA, 492 bp, Homo sapiens
  misc_feature: HIJSMM301C52E9.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggaggaccaaggtggagatcaaacgaactgtggctgcaccatctgtcttcatccttcccgccat

SEQ ID NO: 563438 - DNA, 504 bp, Homo sapiens
  misc_feature: HIJSMM301D27NH.43.3.A03.1.454.light.4.raw
tgtgagtagtcacgaccggtgctcgatttagagagcgtcacaggggctggtggtagctcaggaagcagagcctggagcatctccactatggcctgggctccactacttctcaccctcctcgctcactgcacaggttcttgggccagttttatgctgactcagccccactctgtgtcggagtctccggggaagacggtaaccatctcctgcacccgcagcggtggctttattgccagcaataatatgcagtggtaccagcagcgcccgggcagtccccccaccactgtgatctatgaggatgaccaaagaccctctggggtccctaatcggttctctggctccgtcgacacctcctccaactctgcctacctcaccatctctggactgaagactgaggacgaggctgactattactgtcactcttatgatcgcaacaacagggtgttcggcggagggaccaggttgaccgtcctaggtcagcccaaggccaaccccactgtcact

SEQ ID NO: 563439 - DNA, 498 bp, Homo sapiens
  misc_feature: HIJSMM301D1K0D.14.36.D03.1.454.light.4.raw
cgtctagtaccacgaccggtgctcgatttagctgcgtcacgatctctcttgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaacaacacccaggcaaagcccccaaactcatgatttatgaggtcagtaatcggccctcaggggtttctaatcgcttctctggctccaagtctggcaacacggcctccctgaccatctctgggctccaggctgaggacgagtctgattattattgcagctcatatgcacctggcagcaatcatgtggttttcggtcggggggaccgaaggtgaccgtcctaggtcagcccaaggcc

SEQ ID NO: 563440 - DNA, 517 bp, Homo sapiens
  misc_feature: HIJSMM301CVDEV.41.25.C03.1.454.light.4.raw
tctatactatcacgaccggtgctcgatttagtagtgtagatttgggtttgggggatagctcaggaagcagagcctggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctggggtcccctttcggtttctggctccatcgacagtccctccaactccgcctcccttaccatatctgggctgaagagtgaggacgaggctgactacttctgtcagtcttatgatataaacaattatgtgataattggcggagggaccagggtgaccgtcctaggtcagccaaggctgccccctcggtcactctgttcccgt

SEQ ID NO: 563441 - DNA, 445 bp, Homo sapiens; identical to SEQ ID NO: 537075
  misc_feature: HIJSMM301EI7ER.5.9.A09.1.454.light.4.raw

SEQ ID NO: 563442 - DNA, 504 bp, Homo sapiens; identical to SEQ ID NO: 539690
  misc_feature: HIJSMM301ADO4B.47.65.F10.1.454.light.4.raw

SEQ ID NO: 563443 - DNA, 511 bp, Homo sapiens; identical to SEQ ID NO: 537464
  misc_feature: HIJSMM301CG46L.7.34.D01.1.454.light.4.raw

SEQ ID NO: 563444 - DNA, 506 bp, Homo sapiens; identical to SEQ ID NO: 555446
  misc_feature: HIJSMM301DTBTU.47.55.E11.1.454.light.4.raw

SEQ ID NO: 563445 - DNA, 493 bp, Homo sapiens
  misc_feature: HIJSMM301D4QT6.16.86.H09.1.454.light.4.raw
tgtactactccacgaccggtgctcgatttagtgctatagacttgggtttgggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctgtattcggcggtgggaccaagctgaccgtcctaggtcagcccaagg

SEQ ID NO: 563446 - DNA, 505 bp, Homo sapiens; identical to SEQ ID NO: 535503
  misc_feature: HIJSMM301DHLMU.8.28.C06.1.454.light.4.raw

SEQ ID NO: 563447 - DNA, 510 bp, Homo sapiens; identical to SEQ ID NO: 538614
  misc_feature: HIJSMM301AYQ6L.19.59.F04.1.454.light.4.raw

SEQ ID NO: 563448 - DNA, 500 bp, Homo sapiens
  misc_feature: HIJSMM301DMN6Q.22.27.C05.1.454.light.4.raw
acatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttattactgtcagcaatattatattcctcctcagacgttcggccaagggaccaaggtggaaatcaaacgaactgtggctgcaccta

SEQ ID NO: 563449 - DNA, 445 bp, Homo sapiens
  misc_feature: HIJSMM301EF528.10.76.G10.1.454.light.4.raw
catagtagtgcacgaccggtgctcgatttagtcactcatacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctcgttcccaccctcctccactactatg

SEQ ID NO: 563450 - DNA, 493 bp, Homo sapiens; identical to SEQ ID NO: 539456
  misc_feature: HIJSMM301BGFTZ.10.79.H02.1.454.light.4.raw

SEQ ID NO: 563451 - DNA, 497 bp, Homo sapiens; identical to SEQ ID NO: 538030
  misc_feature: HIJSMM301CENDT.40.23.C01.1.454.light.4.raw

SEQ ID NO: 563452 - DNA, 501 bp, Homo sapiens
  misc_feature: HIJSMM301BUTUO.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtggctccggtccgaggatgaggctgactattactgtgcatcacgggacgcaacatgggatgacaatctgagcggttgggtgttcggcggagggaccaaactgaccgtcctaggtcagcccaa

SEQ ID NO: 563453 - DNA, 494 bp, Homo sapiens; identical to SEQ ID NO: 534992
  misc_feature: HIJSMM301C9IKZ.9.1.A01.1.454.light.4.raw

SEQ ID NO: 563454 - DNA, 490 bp, Homo sapiens; identical to SEQ ID NO: 550493
  misc_feature: HIJSMM301C93P2.10.59.F04.1.454.light.4.raw

SEQ ID NO: 563455 - DNA, 494 bp, Homo sapiens; identical to SEQ ID NO: 549057
  misc_feature: HIJSMM301DD247.10.33.C11.1.454.light.4.raw

SEQ ID NO: 563456 - DNA, 516 bp, Homo sapiens
  misc_feature: HIJSMM301B0MCN.13.55.E11.1.454.light.4.raw
tcacgtactacacgaccggtgctcgatttagcactcgcacgttgggtttggggagcctgggcctcaggaagcagcatcgggggtgccgcagccatggcctggaccgctctcctgctgagcctccttgctcactttacagcttctgtggcctcctatgagttgactcagccactctcagtgtcagtggccccgggacagacggccacaattccctgtgagggaaacaaccttagaagtcagaatgtccactggtaccagcagaagtcaggccaggcccctgtggtggtcatttatcaagataccaaacggccctcagggatccctgagcgattctctggttccaactctgggaatacagccactctgaccatcaacgggactcgaggctatggatgaggctgactattactggtcaggtgtgggacagcaacacctatgtggtattcggcggagggaccaagctgacccgtcctaggtcacgcccaaggctgccccctcggtccactctgttccccg

SEQ ID NO: 563457 - DNA, 509 bp, Homo sapiens; identical to SEQ ID NO: 539269
  misc_feature: HIJSMM301BGWSX.4.57.F02.1.454.light.4.raw

SEQ ID NO: 563458 - DNA, 506 bp, Homo sapiens; identical to SEQ ID NO: 539721
  misc_feature: HIJSMM301ALUQX.3.79.H02.1.454.light.4.raw

SEQ ID NO: 563459 - DNA, 516 bp, Homo sapiens
  misc_feature: HIJSMM301AD0KN.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctcggtcactctgttcccaccctcctcgctacgtacgac

SEQ ID NO: 563460 - DNA, 417 bp, Homo sapiens; identical to SEQ ID NO: 543891
  misc_feature: HIJSMM301BUEET.18.78.H01.1.454.light.4.raw

SEQ ID NO: 563461 - DNA, 517 bp, Homo sapiens; identical to SEQ ID NO: 536980
  misc_feature: HIJSMM301CENDG.5.27.C05.1.454.light.4.raw

SEQ ID NO: 563462 - DNA, 486 bp, Homo sapiens; identical to SEQ ID NO: 535043
  misc_feature: HIJSMM301A3VG6.46.35.D02.1.454.light.4.raw

SEQ ID NO: 563463 - DNA, 476 bp, Homo sapiens; identical to SEQ ID NO: 538611
  misc_feature: HIJSMM301AM32I.7.81.H04.1.454.light.4.raw

SEQ ID NO: 563464 - DNA, 495 bp, Homo sapiens
  misc_feature: HIJSMM301EJSOU.12.12.B01.1.454.light.4.raw
atacgacgtacacgaccggtgctcgatttagtagtgtagattccgcggggacagcgaccatgttctgagggtcagactcaaacagcatcacccaggacaccgacaggagccggggcacaatgagagcctcacctgggaaatgcagccggaggcacctgggcccagatgtcagcctgggcagctcccacagtgctggaattccctggaagatgccccaaggttgagtctctgaggcctcctatgagctgacacagccaccctcggtgtcagtgtccccaggacaaacggccaggatcacctgctctggagctgcattgccaataaaatctccttattggtaccagcagaagtcaggccaggcccctgtattggtcatctatgaggacaacagacgaccttccgggatccctcgagagattctctggctccacctcagggacaatggccaccttgactatcagtggcgcccacggtggaggatgaggctgacttaac

SEQ ID NO: 563465 - DNA, 485 bp, Homo sapiens
  misc_feature: HIJSMM301CX8A0.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacatattattatacttcgtggacgttcggccaagggaccaaggtggatatcagacgaa

SEQ ID NO: 563466 - DNA, 511 bp, Homo sapiens
  misc_feature: HIJSMM301BZCNQ.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgttcggtccagggaccgacacgtagaatagagacgaactagtggcgtgcgaccactactgtcttctactcttcccgt

SEQ ID NO: 563467 - DNA, 514 bp, Homo sapiens; identical to SEQ ID NO: 544242
  misc_feature: HIJSMM301DWIQ3.43.23.C01.1.454.light.4.raw

SEQ ID NO: 563468 - DNA, 499 bp, Homo sapiens
  misc_feature: HIJSMM301EJK23.22.9.A09.1.454.light.4.raw
acatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcagtgggtctggaagagacttcactctcaccatcaacagcctagagcctgacgattctgcagtttattactgtcagcagcgtaccaagtggcctccgtactttcggccgagggggccaagctggagatcagacgaactgtggctgcaccatctgtcttcatcttccccg

SEQ ID NO: 563469 - DNA, 507 bp, Homo sapiens
  misc_feature: HIJSMM301ETX7B.47.85.H08.1.454.light.4.raw
agctcacgtacacgaccggtgctcgatttagtatcactcagtcgcgggggctggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgccccctcggtcactc

SEQ ID NO: 563470 - DNA, 489 bp, Homo sapiens
  misc_feature: HIJSMM301EUZQA.21.55.E11.1.454.light.4.raw
  modified_base (486)..(486): a, c, t, g, unknown or other
tcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattatttgccggacaagtcacgacataaacacctttttaaattggtatcagcacaaaccagggaaggccccaaagctcctgatcgatgctgcatccaatttagagagtggggtcccatccaggttcagtggcgatggatctgggacaaatttcactctcaccatcagcagtctgcaacctgaagattttgcaacttactattgtcaacagagttacagtattcctttcactttcggccctgggaccgaagtcgatatcaaacgaactgtggctgcaccatcngtt

SEQ ID NO: 563471 - DNA, 454 bp, Homo sapiens
  misc_feature: HIJSMM301AQOMC.18.78.H01.1.454.light.4.raw
tacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggatctgggaccaaggtcaccgtcctaagtcagcccaaggccaacccctctgtcactctgttcccgccctcctccatactcgta

SEQ ID NO: 563472 - DNA, 491 bp, Homo sapiens; identical to SEQ ID NO: 535294
  misc_feature: HIJSMM301E06KL.16.68.G02.1.454.light.4.raw

SEQ ID NO: 563473 - DNA, 500 bp, Homo sapiens
  misc_feature: HIJSMM301DCFLQ.48.59.F04.1.454.light.4.raw
agtatacatacacgaccggtgctcgatttagtacacacacttagggattggggggggaaccatggaaaccccagcgcagcttctcttcctcctgctactctggctcccagatgcccccggagaaattgtgttgacgcagtctccagacaccctgtctttgtctccaggggaaagagccaccttctcctgcaggttcagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttcccgccatctgatatgtatactc

SEQ ID NO: 563474 - DNA, 506 bp, Homo sapiens
  misc_feature: HIJSMM301CDVNP.10.27.C05.1.454.light.4.raw
catagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggggtttctagtcgcttctctgcctccaagtctggcaacacggcctccctgacaatctctgggctccaggctgacgacgaggctgaatattactgcagctcatatgtagatggtgcctctttcaaggttttcggcggagggaccaggctgaccgtcctaagtcagcccaaggctgccccctcggt

SEQ ID NO: 563475 - DNA, 500 bp, Homo sapiens; identical to SEQ ID NO: 540012
  misc_feature: HIJSMM301B5WWZ.52.34.D01.1.454.light.4.raw

SEQ ID NO: 563476 - DNA, 487 bp, Homo sapiens; identical to SEQ ID NO: 536536
  misc_feature: HIJSMM301DHSCI.26.45.E01.1.454.light.4.raw

SEQ ID NO: 563477 - DNA, 504 bp, Homo sapiens; identical to SEQ ID NO: 535077
  misc_feature: HIJSMM301DKKGY.8.28.C06.1.454.light.4.raw

SEQ ID NO: 563478 - DNA, 494 bp, Homo sapiens; identical to SEQ ID NO: 534994
  misc_feature: HIJSMM301EB3K6.27.78.H01.1.454.light.4.raw

SEQ ID NO: 563479 - DNA, 506 bp, Homo sapiens; identical to SEQ ID NO: 534969
  misc_feature: HIJSMM301A48WG.18.37.D04.1.454.light.4.raw

SEQ ID NO: 563480 - DNA, 496 bp, Homo sapiens
  misc_feature: HIJSMM301BQVL2.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgctaacttattactgtctacaagattcttcttaccctcggacgtcgtccgacgggaccgacggtcggatgtctacgacgaactgtggtcgtgcgaccactcttcg

SEQ ID NO: 563481 - DNA, 507 bp, Homo sapiens
  misc_feature: HIJSMM301DCB0V.13.36.D03.1.454.light.4.raw
tcacgtactacacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaacacccaggcaaagcccccaaactcattatttacggggtcaataagcggccctcagggctttctgatcgcttctctggctccaagtctggcaacacggcctccctgacaatctctggactccaggccgaggacgaggctgatttttactgttgttcatatgcaggaaggagtgattatgtctttggaagtgggaccaaggtcaccgtccttggtcagcccaaggccaaccccactgtca

SEQ ID NO: 563482 - DNA, 454 bp, Homo sapiens
  misc_feature: HIJSMM301DVXGV.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccgccctcctccaccgagata

SEQ ID NO: 563483 - DNA, 502 bp, Homo sapiens
  misc_feature: HIJSMM301CUE3C.17.61.F06.1.454.light.4.raw
cgtagactagcacgaccggtgctcgatttagctacgctctaagggaaaggggcttcagggacctctgggctgatccttggtctcctgctcctcaggctcaccggggcccagcacagactcactggcatgtgtttctccctctttccagggtcctgggcccagtctgccctgactcagcctgcctccgtgtctgggtctcttggacagtcgatcaccatctcctgcactggaaccagcagtgacgttggtacttataactatgtctcctggtaccaacagaacccaggcaaagcccccaaactcatgatttatgaggtcagtaatcggccctcaggggtttctaatcgcttctctggctccaagtctggcaacatggcctccctgaccatctctgggctccaggctgaggacgaggctgattattactgcagctcatatacaagcagcagcactccttgggtgttcggcggagggaccaagctgaccgtctaggtcagcccaa

SEQ ID NO: 563484 - DNA, 523 bp, Homo sapiens
  misc_feature: HIJSMM301AE8AR.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggccggaggggaccaggctgaccgtcctaggtcagcccaaggctgccccctcggtcactctgttcccaccct

SEQ ID NO: 563485 - DNA, 499 bp, Homo sapiens
  misc_feature: HIJSMM301CHEQ7.5.24.C02.1.454.light.4.raw
atcagacacgcacgaccggtgctcgatttagtacagatcgttagggaaagggggctggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcgggggaccaagctgaccgtcctaggtcagcccaagg

SEQ ID NO: 563486 - DNA, 492 bp, Homo sapiens
  misc_feature: HIJSMM301D37BZ.3.72.G06.1.454.light.4.raw
agacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccaggggaaagagccactctctcctgcagggccagtcagagtgttagcagctacttagcctggtaccagcagaaacctggccaggctcccaggctcctcatttatgatgcatccaacagggccactggcatcccagccaggttcagtggcagtgggtctgggacagacttcactctcaccatcagcagcctagagcctgaagattttgcagtttattactgtcagcagcgtagcaactggcctctcaccttcggcggagggaccgaaggtaggaggatcaaacgaactagtggctgcaccatct

SEQ ID NO: 563487 - DNA, 490 bp, Homo sapiens
  misc_feature: HIJSMM301AJ462.4.22.B11.1.454.light.4.raw
agcactgtagcacgaccggtgctcgatttagacgacagctcagggggatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtgtacagtgatggaaacacctacttgaattggtttcagcagaggccaggccaatctccaaggcgcctaatttatgaggtttctaaccgggactctggggtcccagacagattcagcggcagtgggtcaggcactgatttcacactgaaaatcagcacggtggaggctgaggatgttggggtttattctgcatgcaaggtacacactggccgtacacttttggccaggggaccaagctggagatcaaacgaactgtggctgcaccat

SEQ ID NO: 563488 - DNA, 496 bp, Homo sapiens
  misc_feature: HIJSMM301ERDLB.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggcggagggaccgagggtggaggatcaaacgaaactgtggctgcaccatctgtcttcatt

SEQ ID NO: 563489 - DNA, 496 bp, Homo sapiens
  misc_feature: HIJSMM301AUO7A.51.53.E09.1.454.light.4.raw
cgatcgtatacacgaccggtgctcgatttagagagagtgtgttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataatttggggtctaagtatgtttcgtggtatcaacatcacccaggccggtccccgatactgctcctctatcatgatgccaagcggccctcagggatccctgagcgattctctggctccaactctggggacacagccactctgaccatccgcgggacccaggctgtggatgaggctgactattactgtcaggcgtgggacagggaggctgcgattttcggcggagggaccagtctgaccgtcctaggtcagcccaaggctgccccctcggtcactc

SEQ ID NO: 563490 - DNA, 484 bp, Homo sapiens; identical to SEQ ID NO: 535400
  misc_feature: HIJSMM301C88M1.46.26.C04.1.454.light.4.raw

SEQ ID NO: 563491 - DNA, 510 bp, Homo sapiens; identical to SEQ ID NO: 561598
  misc_feature: HIJSMM301DV1VX.48.53.E09.1.454.light.4.raw

SEQ ID NO: 563492 - DNA, 487 bp, Homo sapiens; identical to SEQ ID NO: 549649
  misc_feature: HIJSMM301D5911.19.71.G05.1.454.light.4.raw

SEQ ID NO: 563493 - DNA, 511 bp, Homo sapiens; identical to SEQ ID NO: 543656
  misc_feature: HIJSMM301EC5OI.15.86.H09.1.454.light.4.raw

SEQ ID NO: 563494 - DNA, 506 bp, Homo sapiens
  misc_feature: HIJSMM301C3EXC.40.23.C01.1.454.light.4.raw
tctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtccttctctccaggggaaagagcctccctctcctgcagggccagtcagagtattaataccttcttggcctggtaccagcaaaagcctggccaggctcccagactcctcatctatgatgcatccaacagggccactggcgtcccggccaggttcagtggcagtgggtctgggacagacttcactctcaccatcagcagcctagagcctgaagattttgcagtttattactgtcagcagcgtgccaactggcctctcactttcggcggagggaccaagggtggaggatcaaacgaactgtggctgcaccatctgtcttcatcttccccg

SEQ ID NO: 563495 - DNA, 520 bp, Homo sapiens; identical to SEQ ID NO: 535686
  misc_feature: HIJSMM301AR85V.41.19.B08.1.454.light.4.raw

SEQ ID NO: 563496 - DNA, 502 bp, Homo sapiens
  misc_feature: HIJSMM301D53IP.40.28.C06.1.454.light.4.raw
tctagcgactcacgaccggtgctcgatttagagctcacgtattgggtttggggagagaagagcttctcagttaggacccagagggaaccatggaaaccccagcgcagcttctcttcctcctgctactctggctcccagatgccaccggagaaattgtgttgacgcagtctccaggtaccctgtctttgtctccaggggaaagagccaccctctcctgcagggccagtcagagtattaggaacactgtccaaggctggtatcagcataaacctggccaggctcccaggctcctcatctatgagacgtccaggagggccagtggcatcccagacaggttcagtggcagtgggtctgggaccgacttcactctaaccatcagtagactggaacctgaagactctgcagtgtattactgtcaacactttgaaggcccacttatcacattcggcggagggaccaaggtggagatcaagcgaactgtggctgcaccatctgtcttcat

SEQ ID NO: 563497 - DNA, 488 bp, Homo sapiens
  misc_feature: HIJSMM301BLAET.48.60.F05.1.454.light.4.raw
agtatacatacacgaccggtgctcgatttagtacgtcatcagggggatcaggacttctcagttcatcttctcaccatgaggctccctgctcagctcctggggctgctaatgctctggatccctggatccactgcgggtgttgtgttgacccaggctcccctgtctctgtccgtcacccctggacagccggccgccatgtcgtgcaattctagtcggagcctcttctatgaggacggcaggacctacttctattggtacatgcagaagccgggccggtctccacagctcctgatgtctgagatttccagacgattccctggagtgccagagaggttcagtggcagcggagcagggacagagttcacactgaaaatcagccgggtggaggctgaggatgttggcctttattactgcatgcaaggtatcttcctcccatacacttttggcccggggaccaaggtggatctcaaaagaactgtggctgcacc

SEQ ID NO: 563498 - DNA, 490 bp, Homo sapiens
  misc_feature: HIJSMM301EWYBX.48.73.G07.1.454.light.4.raw
agtatacatacacgaccggtgctcgatttagctctacgctcagggggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggaccttcggtccaagggaccgacgggtggaaagtacaaacgaactagtggctgcaccatctgtctt

SEQ ID NO: 563499 - DNA, 487 bp, Homo sapiens
  misc_feature: HIJSMM301DVAR7.9.59.F04.1.454.light.4.raw
tgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacaggctgcccccaacttcggccaggggacacgactggagattaaacgaactgtggctgcaccat

SEQ ID NO: 563500 - DNA, 479 bp, Homo sapiens
  misc_feature: HIJSMM301B5QHY.11.11.A11.1.454.light.4.raw
cgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctcctaaactgctcatctcctgggcatctacccgggcacccggagtccctgaccgattcagtggcagcgggtctgggacagacttcactctcaccatcagcaacctgcaggctgaagatgtggcagtttattactgtcagcagtattgtgaagctccgctcactttcggcggacgggaccgcggtggagatcagacgaactgtggctgcaccatctgtctt

SEQ ID NO: 563501 - DNA, 489 bp, Homo sapiens; identical to SEQ ID NO: 535139
  misc_feature: HIJSMM301BY6V0.14.55.E11.1.454.light.4.raw

SEQ ID NO: 563502 - DNA, 507 bp, Homo sapiens
  misc_feature: HIJSMM301CUPZE.8.1.A01.1.454.light.4.raw
ctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgaattgccaaagaaatatgcttattggtaccagcagaagtcaggccaggcccctgtcctggtcatttatgaggacaagaaacgaccctccgggatccctgacagactctctggctccagctcagggacagtggccaccttgactatcactggggcccaggtggaggatgaaggagactactattgttactctccagagaaggatggtcatcattgggtgttcggcggagggaccaagctgaccgtcctaagtcagcccaaggctcgccccctcggtcactctcgttcccaccct

SEQ ID NO: 563503 - DNA, 497 bp, Homo sapiens
  misc_feature: HIJSMM301DBJRJ.7.5.A05.1.454.light.4.raw
cgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcaggggtttccaatcgcttctctggctccaagtctggcgacacggcctccctgaccatctctgggctccaggctgaagacgaggctgattattactgcagctcatatacaggcagcagcactcaggttttcggcggagggaccaagctgaccgtcctaggtcagcccaaggctgccccctcggt

SEQ ID NO: 563504 - DNA, 497 bp, Homo sapiens
  misc_feature: HIJSMM301AS11Y.3.33.C11.1.454.light.4.raw
agacgcactccacgaccggtgctcgatttagagtgagctcgttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggaggaccaagctgaccgtcctaggtcagcccaaggctgccccccg

SEQ ID NO: 563505 - DNA, 480 bp, Homo sapiens
  misc_feature: HIJSMM301DQW9D.8.12.B01.1.454.light.4.raw
ctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattggggataaatatgcttgctggtatcagcagaggccaggccagtcccctgtactggtcatctatcaagataacaagcggccctcagggatccctgagcgattctctggctccaactctgggaacacagccactctgaccatcagcgggacccaggctacggatgaggctgactattactgtcaggcgtgggacagcagcacctatgtggttttcggcggagggaccaagctgaccgtccttggtcagcccaaggctg

SEQ ID NO: 563506 - DNA, 444 bp, Homo sapiens; identical to SEQ ID NO: 535042
  misc_feature: HIJSMM301DNIT4.10.76.G10.1.454.light.4.raw

SEQ ID NO: 563507 - DNA, 481 bp, Homo sapiens
  misc_feature: HIJSMM301EZT86.48.5.A05.1.454.light.4.raw
agtatacatacacgaccggtgctcgatttagatagatagacagggggagtcagacccagtcaggacacagcatggacatgagggtccccgctcagctcctggggctcctgctgctctggctcccaggtgccaaatgtgacatccagatgacccaggctccttccaccctgtctgcatctgtaggagacagagtcaccatcacttgccgggccagtcagtagtattgttagctggttggcctggtatcaacagagaccagggaaagcccctaaactcctgatctatacggcatctactttacagagtggggtcccatcaaggttcagcggcagtgcatctgggacagaattcactctcaccatcagcagcctgcagcctgatgattttgcaacttattactgccaacagtattatacttatccatggacgttcggtccaagggaccaaggtggaaagtcaaacgaactagtggctgcaccat

SEQ ID NO: 563508 - DNA, 479 bp, Homo sapiens; identical to SEQ ID NO: 535118
  misc_feature: HIJSMM301CUL9S.13.59.F04.1.454.light.4.raw

SEQ ID NO: 563509 - DNA, 511 bp, Homo sapiens
  misc_feature: HIJSMM301AI4FE.40.43.D10.1.454.light.4.raw
tctagcgactcacgaccggtgctcgatttagactagcagtaagggggaggaactgctcagttaggacccagagggaaccatggaagccccagctcagcttctcttcctcctgctactctggctcccagaaaacaccggagaaattctgttgacacagtctccaggcaccctgtctttgtctccaggggaaagagccaccctctcctgcagggccagtcagagtcttagcaactacttagtctggtaccaacagaaacctggccaggctcccagactcctcatctatgatgcgtcttccagggccactggcgtcccggccaggttcagtggcagtgggtctgggacagccttcactctcaccatcagcagcctggagcccgaagattttgcggtttattactgtcagcagcgtgccgactggccccccacgttcggcggagggaccaaggtggacatcaaacgaactgtggctgcaccatctgtcttcatcttcccgccatctgaagtcgct

SEQ ID NO: 563510 - DNA, 484 bp, Homo sapiens; identical to SEQ ID NO: 538247
  misc_feature: HIJSMM301CU13D.14.53.E09.1.454.light.4.raw

SEQ ID NO: 563511 - DNA, 486 bp, Homo sapiens; identical to SEQ ID NO: 537428
  misc_feature: HIJSMM301B5IWF.47.62.F07.1.454.light.4.raw

SEQ ID NO: 563512 - DNA, 494 bp, Homo sapiens; identical to SEQ ID NO: 534994
  misc_feature: HIJSMM301DI3Y1.27.78.H01.1.454.light.4.raw

SEQ ID NO: 563513 - DNA, 507 bp, Homo sapiens
  misc_feature: HIJSMM301D8UGV.16.46.E02.1.454.light.4.raw
tgtactactccacgaccggtgctcgatttagactcatctacagggaaagggggggagtctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcacgtcctaggtcagcccaaggccaaccccactgtcact

SEQ ID NO: 563514 - DNA, 453 bp, Homo sapiens
  misc_feature: HIJSMM301ECEAR.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccacctcctccacgagagta

SEQ ID NO: 563515 - DNA, 494 bp, Homo sapiens; identical to SEQ ID NO: 541035
  misc_feature: HIJSMM301EYI5P.26.12.B01.1.454.light.4.raw

SEQ ID NO: 563516 - DNA, 504 bp, Homo sapiens
  misc_feature: HIJSMM301AUJHO.12.53.E09.1.454.light.4.raw
atacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaagctgaccgtcctgggtcagcccaaggctgcccctcggtcactctgttcccaccctcctctacgtcgtat

SEQ ID NO: 563517 - DNA, 495 bp, Homo sapiens
  misc_feature: HIJSMM301AT7YP.11.81.H04.1.454.light.4.raw
cgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtacatccaccagggccactggtatcccagccaggttcagtggcagtgggtctgggacagagttcactctcaccatcagcagcctgcagtctgaagattttgcagtttttactgtcagcagtatagtaactggcctccgtacacttttggccaggggaccaagctagaaatcaaacgaactgtggctgcaccatctgtcttcatt

SEQ ID NO: 563518 - DNA, 503 bp, Homo sapiens; identical to SEQ ID NO: 535044
  misc_feature: HIJSMM301CP4UR.19.78.H01.1.454.light.4.raw

SEQ ID NO: 563519 - DNA, 498 bp, Homo sapiens
  misc_feature: HIJSMM301B79LL.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtctagcagtataataactggcctccacggtacacttttggccaggggaccaagctggagatcaaacgaactgtggctgcaccatctgtt

SEQ ID NO: 563520 - DNA, 495 bp, Homo sapiens; identical to SEQ ID NO: 538269
  misc_feature: HIJSMM301DQZFP.9.1.A01.1.454.light.4.raw

SEQ ID NO: 563521 - DNA, 503 bp, Homo sapiens
  misc_feature: HIJSMM301DWFP7.53.49.E05.1.454.light.4.raw
cgcgtatacacacgaccggtgctcgatttagagcgactagcaacacacaaaggggctgggcctaaggaagcagcactggtggtgcctcagccatggcctggaccgttctcctcctcggcctcctctctcactgcacagactctgtgacctcctatgtgctgactcaggcaccctcgctgtctgtggccccaggacagacggccaggattgcttgtgggggaaacaacgttggaagtaacagtgtgcattggtaccagcagaagccacgccaggcccctgtcctggtcttctttgatcatggagaccggccctcagggatccctgagcgattctctggctccaagtctgggaacacggccactttgaccatcatcagggtcgaagccggggatgaggccgactactactgtcagctgtgggacagtagtattcatcagggggcattcggcggagggaccaagctgaccgtcctgggtcagcccaaggctgcccctcggtcactc

SEQ ID NO: 563522 - DNA, 520 bp, Homo sapiens; identical to SEQ ID NO: 535686
  misc_feature: HIJSMM301D9V8K.41.19.B08.1.454.light.4.raw

SEQ ID NO: 563523 - DNA, 503 bp, Homo sapiens
  misc_feature: HIJSMM301EAECX.15.86.H09.1.454.light.4.raw
  modified_base (399)..(399): a, c, t, g, unknown or other
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccanacaattgatggccaagacggttgggtgttcggcggagggaccaaggctgaccgtccaggtcagcccaaggctgccccctggtcactctgttcccaccctcctcg

SEQ ID NO: 563524 - DNA, 491 bp, Homo sapiens
  misc_feature: HIJSMM301BU5AJ.52.27.C05.1.454.light.4.raw
cgcagtacgacacgaccggtgctcgatttagacgcgatcgaagggtttgggggagtcagtctcagtcaggacacagcatggacatgagggtccccgctcagctcctggggctcctgctactctggctccgaggtgccagatgtgacacccagatgacccagtctccatcctccctgtctgcatctgtaggagacagagtcaccatcacgtgccgggcaagtcagagcattggcaggtatttaaattggtatcaacagaaaccagggaaagcccctaggctcctgatctatgctgcatcccgtttgcaaagtggggtcccgtcaaggttcagtggccgtggatctgggacagatttcactctcaccatcagcagtctccaacctgaagattttgcaatttactactgtcaacagagtgacaatacccctcagactttcggccctcgggaccacgagtggatatcaacgaaactgtggctgcacatctgtctt

SEQ ID NO: 563525 - DNA, 494 bp, Homo sapiens; identical to SEQ ID NO: 534992
  misc_feature: HIJSMM301EYFQO.9.1.A01.1.454.light.4.raw

SEQ ID NO: 563526 - DNA, 505 bp, Homo sapiens; identical to SEQ ID NO: 536117
  misc_feature: HIJSMM301BRCAX.8.71.G05.1.454.light.4.raw

SEQ ID NO: 563527 - DNA, 492 bp, Homo sapiens; identical to SEQ ID NO: 558606
  misc_feature: HIJSMM301BM880.16.53.E09.1.454.light.4.raw

SEQ ID NO: 563528 - DNA, 486 bp, Homo sapiens; identical to SEQ ID NO: 535043
  misc_feature: HIJSMM301AQJ4O.46.35.D02.1.454.light.4.raw

SEQ ID NO: 563529 - DNA, 505 bp, Homo sapiens; identical to SEQ ID NO: 536254
  misc_feature: HIJSMM301BYDDA.7.71.G05.1.454.light.4.raw

SEQ ID NO: 563530 - DNA, 502 bp, Homo sapiens; identical to SEQ ID NO: 541501
  misc_feature: HIJSMM301DZBKL.17.27.C05.1.454.light.4.raw

SEQ ID NO: 563531 - DNA, 496 bp, Homo sapiens; identical to SEQ ID NO: 535109
  misc_feature: HIJSMM301D4DBB.16.78.H01.1.454.light.4.raw

SEQ ID NO: 563532 - DNA, 510 bp, Homo sapiens
  misc_feature: HIJSMM301A4CDY.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaaatatgcttattggtaccagcagaagtcaggccaggccccaaaattggtcatctatgaagacgacaaacgaccctccgggatccctgagagattctctggctccagctcagggactatggccaccttgactatcagtggggccaagtggaggatgaagctgactactactgttactcaatagagaacagtgataatttctgggtgttcggcggagggaccaaactgaccgtcctaggtcagccaaggctcgccccctcggtcactctcgttccccg

SEQ ID NO: 563533 - DNA, 527 bp, Homo sapiens
  misc_feature: HIJSMM301B6SFG.27.23.C01.1.454.light.4.raw
  modified_base (523)..(523): a, c, t, g, unknown or other
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttggggtgttcggcgggagggaccgaggctgaccgtcctaggtcagcccaaggctcgccccctcggtccactcctgttcccnccct

SEQ ID NO: 563534 - DNA, 516 bp, Homo sapiens
  misc_feature: HIJSMM301DKTSJ.47.53.E09.1.454.light.4.raw
agctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctctgggatccccgagcgattctctggctccaagtctgggaacacggccaccctgaccgtcagcagggtcgacgtcgggatgaggccgtatatttttgtcaggtgtgggagactaattttggtcatatgttgttcggcggagggaccaagctgaccgtcctcggtcagcccaaggctgccccctcggtcactctgttcccaccctcct

SEQ ID NO: 563535 - DNA, 444 bp, Homo sapiens; identical to SEQ ID NO: 535192
  misc_feature: HIJSMM301BZUNA.5.9.A09.1.454.light.4.raw

SEQ ID NO: 563536 - DNA, 511 bp, Homo sapiens; identical to SEQ ID NO: 535406
  misc_feature: HIJSMM301DMXA2.43.59.F04.1.454.light.4.raw

SEQ ID NO: 563537 - DNA, 509 bp, Homo sapiens
  misc_feature: HIJSMM301AOWIF.47.55.E11.1.454.light.4.raw
agctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggccccgaggatgaggctgattattactgtgtaggttgggatcgcagcctgactgcttacgtcttcggagctgggaccaaggtcaccgtcctaggtcagcccaaggccaacccca

SEQ ID NO: 563538 - DNA, 485 bp, Homo sapiens; identical to SEQ ID NO: 536263
  misc_feature: HIJSMM301DUXJG.47.78.H01.1.454.light.4.raw

SEQ ID NO: 563539 - DNA, 517 bp, Homo sapiens
  misc_feature: HIJSMM301DTP4X.13.53.E09.1.454.light.4.raw
  modified_base (506)..(506): a, c, t, g, unknown or other
tcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcagggtctacagcctgaagattttgcgacttactattgtcaacagagttaccttctccccccggacgttcgtccgaacgggaccgaacggtaggaaagtacaaagacgaactacgtggcgtgcgaccaactctntcgttctactt

SEQ ID NO: 563540 - DNA, 488 bp, Homo sapiens
  misc_feature: HIJSMM301DTQMW.4.36.D03.1.454.light.4.raw
agcactgtagcacgaccggtgctcgatttagctgcgtcacgatctctcttggggggagtcagactcagtcaggacacagcatggacttgagggtccccgctcagctcctggggctcctgctgctctggctcccaggtgccaaatgtgacatccagatgacccagtctccttccaccctgtctgcatctgtgggggacagagtcaccatcacttgccgggccagtcagagtgttgataactggttggcctggtatcagcagaaaccagggaaagcccctaaactcctgatttatgatgcctccggtttggaaagtggggtcccatcaaggttcagcggcagtggatctgggacagaattcactctcaccatcagcagcctgcagcctgatgattttgcaacttattactgccaacagtattatagtttattctttgacgttcggccaagggaccaaggtggaaatcaaacgaactagtggctgcaccat

SEQ ID NO: 563541 - DNA, 485 bp, Homo sapiens; identical to SEQ ID NO: 536630
  misc_feature: HIJSMM301DNADY.13.56.F01.1.454.light.4.raw

SEQ ID NO: 563542 - DNA, 503 bp, Homo sapiens
  misc_feature: HIJSMM301D7OGP.5.24.C02.1.454.light.4.raw
atcagacacgcacgaccggtgctcgatttagtacagatcgttagggaaagggcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcc

SEQ ID NO: 563543 - DNA, 504 bp, Homo sapiens
  misc_feature: HIJSMM301CNBME.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagctggccgttcactttcggcggagggaccaaggtggacctcaaacgaactgtggctgcaccatctgtcttcatcttcccgcc

SEQ ID NO: 563544 - DNA, 495 bp, Homo sapiens; identical to SEQ ID NO: 537415
  misc_feature: HIJSMM301B7CRL.4.27.C05.1.454.light.4.raw

SEQ ID NO: 563545 - DNA, 491 bp, Homo sapiens; identical to SEQ ID NO: 535194
  misc_feature: HIJSMM301ALGH7.26.78.H01.1.454.light.4.raw

SEQ ID NO: 563546 - DNA, 475 bp, Homo sapiens
  misc_feature: HIJSMM301BC1U5.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcacttcggcctggactgaagtgcatatgaagagaactgtggctgcgtaa

SEQ ID NO: 563547 - DNA, 512 bp, Homo sapiens
  misc_feature: HIJSMM301BAPI4.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggtcggagggaccgaaaactagaaggtcgtaacgaactagtggcgtgcaccactctgtcttctatt

SEQ ID NO: 563548 - DNA, 503 bp, Homo sapiens; identical to SEQ ID NO: 538256
  misc_feature: HIJSMM301DWDDK.19.67.G01.1.454.light.4.raw

SEQ ID NO: 563549 - DNA, 447 bp, Homo sapiens; identical to SEQ ID NO: 535020
  misc_feature: HIJSMM301BWRAH.18.9.A09.1.454.light.4.raw

SEQ ID NO: 563550 - DNA, 522 bp, Homo sapiens
  misc_feature: HIJSMM301AG3PL.16.88.H11.1.454.light.4.raw
tgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttggggcaaagctgccctgaccctttcgggtgcgcagcctgaggatgaggctgagtattactgcttgctctcctatagtggtgttcgggtgttcggcggagggaccaagctgaccgtcctaggtcagcccaaggctcgccccctcggtcactctcgttcccaccctcctcgt

SEQ ID NO: 563551 - DNA, 485 bp, Homo sapiens; identical to SEQ ID NO: 544733
  misc_feature: HIJSMM301AFKRN.46.26.C04.1.454.light.4.raw

SEQ ID NO: 563552 - DNA, 472 bp, Homo sapiens; identical to SEQ ID NO: 535898
  misc_feature: HIJSMM301ASTWV.15.8.A08.1.454.light.4.raw

SEQ ID NO: 563553 - DNA, 533 bp, Homo sapiens
  misc_feature: HIJSMM301E2W8R.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggtcggagggaccgaggctgaccggtccttaggtctagcccaacggcctgccccctccggtcacctctgtttcccgccccct

SEQ ID NO: 563554 - DNA, 501 bp, Homo sapiens; identical to SEQ ID NO: 550139
  misc_feature: HIJSMM301A1YVP.15.56.F01.1.454.light.4.raw

SEQ ID NO: 563555 - DNA, 489 bp, Homo sapiens; identical to SEQ ID NO: 544819
  misc_feature: HIJSMM301BIIV5.11.28.C06.1.454.light.4.raw

SEQ ID NO: 563556 - DNA, 524 bp, Homo sapiens
  misc_feature: HIJSMM301AI4A8.53.80.H03.1.454.light.4.raw
cgcgtatacacacgaccggtgctcgatttagctgtgcgtcgaagggaaaggggctgggcctaaggaagcagcactggtggtgcctcagccatggcctggaccgttctcctcctcggcctcctctctcactgcacaggctctgtgacctcctttgtgctgactcagtcaccctcggtgtcggtggccccaggacagacggccaggattacctgtgggggaaacaacattggaaggaaaagtgtgcactggtaccagcagatgccaggccaggcccctgtgttggtcgtctatgatgatagcgaccggccctcaggggtccctgagcgattctctggctccaactctgggaacacggccaccctgaccataagcagggtcgaagccggggatgaggccgactattactgtcaggtgtgggatactagtagtgatcatccttgggtgttcggcggtgggaccaggctgaccgtcctaggtcagcccaaggctgccccctcggtcactctgttcccgccctcctctcg

SEQ ID NO: 563557 - DNA, 514 bp, Homo sapiens; identical to SEQ ID NO: 554424
  misc_feature: HIJSMM301EFXTH.15.76.G10.1.454.light.4.raw

SEQ ID NO: 563558 - DNA, 508 bp, Homo sapiens
  misc_feature: HIJSMM301C2R2V.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcactactgtcgtttgggtgttcggcggagggaccaagttgaccgtcctaggtcagcccaaggctgccccctcggtcactctgtt

SEQ ID NO: 563559 - DNA, 482 bp, Homo sapiens; identical to SEQ ID NO: 562591
  misc_feature: HIJSMM301D5NPM.49.83.H06.1.454.light.4.raw

SEQ ID NO: 563560 - DNA, 484 bp, Homo sapiens
  misc_feature: HIJSMM301CJ8NI.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactacccctctcactttcggcgggggaccaacggtggagatcaaacgaactgtggctgcaccta

SEQ ID NO: 563561 - DNA, 501 bp, Homo sapiens
  misc_feature: HIJSMM301DALFO.47.55.E11.1.454.light.4.raw
agctcacgtacacgaccggtgctcgatttagcactcgcacgtagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctagggcacgtgagactcaggaaatgaccagagggagtgaatgagggtgcagagaactccatggctaccaggtcagcccaaggccaaccccactgtcactctgttcccaccctcctcta

SEQ ID NO: 563562 - DNA, 482 bp, Homo sapiens
  misc_feature: HIJSMM301EOVXL.48.5.A05.1.454.light.4.raw
agtatacatacacgaccggtgctcgatttagatagatagacagggggcaggagtcagacccagtcaggacacagcatggacatgagggtccccgctcagctcctggggctcctgctgctctggctcccaggtgccaaatgtgacatccagatgacccaggctccttccaccctgtctgcatctgtaggagacagagtcaccatcacttgccgggccagtcagagtattgttagctggttggcctggtatcaacagagaccagggaaagcccctaaactcctgatctatacggcatctactttacagagtggggtcccatcaaggttcagcggcagtgcatctgggacagaattcactctcaccatcagcagcctgcagcctgatgattttgcaacttattactgccaacagtattatacttatccatggacgttcggccaagggaccaaggtggaaatacaaacgaactagtggctgcacca

SEQ ID NO: 563563 - DNA, 510 bp, Homo sapiens
  misc_feature: HIJSMM301AIAS9.21.87.H10.1.454.light.4.raw
tcgtcgctcgcacgaccggtgctcgatttagcagtactgcgttgggtttgggggggtcgacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacgttttaaccttgtctcctggtatcaacaacaccaggacaaagccccaaaactcttaatttctggcgtcaatcagcgaccctcacatgtttccagtcgattctctgcatccaagtctggcaacacggcctttctgacaatctctcaactccaggctgaagacgaggctatttattactgctcctcatacgcaggtggcacatttttctttggtttttggtcggcggggacccagatgactgtcctcagtcagcccaaggctgccccctcggt

SEQ ID NO: 563564 - DNA, 516 bp, Homo sapiens
  misc_feature: HIJSMM301CSEB9.7.34.D01.1.454.light.4.raw
cgtgtctctacacgaccggtgctcgatttagatcgtctgtgttgggtttggggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccgtctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggactccagactgaggacgaggctgattattactgctgctcatatacaggggacagcattatttgggtgtttcggcggagggaccaagctgaccgtcctgcgtcagcccaaggctgccccctcggtcactctcg

SEQ ID NO: 563565 - DNA, 498 bp, Homo sapiens
  misc_feature: HIJSMM301AUMA1.15.1.A01.1.454.light.4.raw
tctacgtagccacgaccggtgctcgatttagacgtctcatcaggggggggtcacaagaggcagcgctctcgggacatctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtc

SEQ ID NO: 563566 - DNA, 502 bp, Homo sapiens
  misc_feature: HIJSMM301BPPOX.41.45.E01.1.454.light.4.raw
tctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcggggggaccaagctgaccgtcctaggtcagcccaaggctgccccctcggtcactctcg

SEQ ID NO: 563567 - DNA, 447 bp, Homo sapiens; identical to SEQ ID NO: 535020
  misc_feature: HIJSMM301BY7QA.18.9.A09.1.454.light.4.raw

SEQ ID NO: 563568 - DNA, 484 bp, Homo sapiens; identical to SEQ ID NO: 536393
  misc_feature: HIJSMM301A5BBJ.4.41.D08.1.454.light.4.raw

SEQ ID NO: 563569 - DNA, 522 bp, Homo sapiens; identical to SEQ ID NO: 541090
  misc_feature: HIJSMM301D3BBZ.27.23.C01.1.454.light.4.raw

SEQ ID NO: 563570 - DNA, 495 bp, Homo sapiens
  misc_feature: HIJSMM301AEV8N.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgcagtttattactgtcagcagtataattactggcctcggacgttcggccaagggaccgaaggtaggaagtcaaacgaactagtggcgtgcaccatctgtctt

SEQ ID NO: 563571 - DNA, 487 bp, Homo sapiens
  misc_feature: HIJSMM301DF3GT.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtacccgtacacttttggccaggggaccaaactggacatcaaacgaactgtggctgcaccatctgtt

SEQ ID NO: 563572 - DNA, 455 bp, Homo sapiens; identical to SEQ ID NO: 535447
  misc_feature: HIJSMM301BHYKE.19.71.G05.1.454.light.4.raw

SEQ ID NO: 563573 - DNA, 478 bp, Homo sapiens
  misc_feature: HIJSMM301B6R8W.26.72.G06.1.454.light.4.raw
agactatactcacgaccggtgctcgatttagctacgactgcaagggaaagggtgagatccctcactgtggctcactttcagcggagggaccacggtggagatcacacgtaagtgcactttcctaatgctttttcttataaggttttaagtttggagcgtttttgtgtttgagatgttagctcaggtcaattccaaagagtaccagattctttcaaaagtcagatgagtaagggatagaaaattagttcaccttaaggaacagccaagcgctagccagttaagtgaggcatctcaattgcaaggttttctctgcatcggtcaggttagtgatattaacagcgaaaagagtatttttgttaaaggggaaagtaatgaagttaacactgtggatcaccttcggccaagggacacgactggagattaaacgaactgtggctgcaccatctgtcttcatcttcccgcatctgaagtatagtct

SEQ ID NO: 563574 - DNA, 488 bp, Homo sapiens
  misc_feature: HIJSMM301A2CBO.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttcgccaagggaccaaggtaggaaagtacaaacgaactagtggcgtgcaccta

SEQ ID NO: 563575 - DNA, 494 bp, Homo sapiens; identical to SEQ ID NO: 535276
  misc_feature: HIJSMM301AD3V1.16.6.A06.1.454.light.4.raw

SEQ ID NO: 563576 - DNA, 495 bp, Homo sapiens; identical to SEQ ID NO: 537415
  misc_feature: HIJSMM301EJWLR.4.27.C05.1.454.light.4.raw

SEQ ID NO: 563577 - DNA, 494 bp, Homo sapiens; identical to SEQ ID NO: 534992
  misc_feature: HIJSMM301A9U23.9.1.A01.1.454.light.4.raw

SEQ ID NO: 563578 - DNA, 510 bp, Homo sapiens
  misc_feature: HIJSMM301D617Y.19.59.F04.1.454.light.4.raw
tactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcgccatctcctgctctggaagcagctccaacattgggaagaattttgtgtcctggtaccagcagctcccaggaacagcccccaaactcctcatttttgacaataataagcgaccctcagggattcctgaccgattctctggctccaagtctggcacgtcagccaccctgggcatcaccggactccagactggggacgaggccgattattactgcggaacatgggatagcagcctgagtactgtgataatcggcggagggaccaagctgaccgtcctaggtcagcccaaggctgccccctcggtcactctgttccca

SEQ ID NO: 563579 - DNA, 487 bp, Homo sapiens
  misc_feature: HIJSMM301AP95G.3.77.G11.1.454.light.4.raw
agacgcactccacgaccggtgctcgatttagctagtcactcaagggaaaggggaggaactgctcagttaggacccagacggaaccatggaagccccagcgcagcttctcttcctcctgctactctggctcccagataccactgcacaaatagtgatgacgcagtctccagccaccctgtctgtttctccaggggaaacagtctccctctcctgcagggccagtcagagtgtcaacaacaacttagcctggtatcaacagaaacctggccaggctcccaggctcctcatctatgatgtgtcttctcgggtcactggtctcccaggcaggttcagtggcagtggatctgggacagaattcacgctcaccatcatcaggctgcggtctgacgacttcgcagtctatttctgtcaacagtacgatggccggcctccgtggacattcggccaaggtacccaaggtggacatcagacgaactgtggctgcacc

SEQ ID NO: 563580 - DNA, 505 bp, Homo sapiens
  misc_feature: HIJSMM301ATC9I.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcgccaaggaccaaggtggaagtcaagcgaactgtggctgcaccatctgtcttcatcttccgcc

SEQ ID NO: 563581 - DNA, 490 bp, Homo sapiens
  misc_feature: HIJSMM301BBYE6.47.36.D03.1.454.light.4.raw
agctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacttgtcgggcgagtcagggtattagcaactggttagcctggtatcaacagaaaccagggaaagcccctaacctcctcatctctactgcatccactttgcaaagtggggtcccatcaaggttcagcggcagtggatctgggacagatttcactctcactatcagcagcctgcagcctgaagattttggaacttattattgtcaacagggtaacagtttccccgctcaccttcggcggagggaccaaggtggagatgaaaagaactgtggctgcaccat

SEQ ID NO: 563582 - DNA, 520 bp, Homo sapiens; identical to SEQ ID NO: 535773
  misc_feature: HIJSMM301CHM1Q.41.19.B08.1.454.light.4.raw

SEQ ID NO: 563583 - DNA, 485 bp, Homo sapiens; identical to SEQ ID NO: 536040
  misc_feature: HIJSMM301A0IPX.15.1.A01.1.454.light.4.raw

SEQ ID NO: 563584 - DNA, 503 bp, Homo sapiens; identical to SEQ ID NO: 536834
  misc_feature: HIJSMM301BMS2L.2.35.D02.1.454.light.4.raw

SEQ ID NO: 563585 - DNA, 488 bp, Homo sapiens; identical to SEQ ID NO: 535990
  misc_feature: HIJSMM301C8GC7.11.28.C06.1.454.light.4.raw

SEQ ID NO: 563586 - DNA, 488 bp, Homo sapiens; identical to SEQ ID NO: 551150
  misc_feature: HIJSMM301AJP84.13.87.H10.1.454.light.4.raw

SEQ ID NO: 563587 - DNA, 466 bp, Homo sapiens; identical to SEQ ID NO: 541765
  misc_feature: HIJSMM301B3Q91.11.70.G04.1.454.light.4.raw

SEQ ID NO: 563588 - DNA, 490 bp, Homo sapiens; identical to SEQ ID NO: 535420
  misc_feature: HIJSMM301ASFPI.3.72.G06.1.454.light.4.raw

SEQ ID NO: 563589 - DNA, 508 bp, Homo sapiens
  misc_feature: HIJSMM301BOQXR.19.78.H01.1.454.light.4.raw
tactctcgtgcacgaccggtgctcgatttagtgtgagtagtttgggtttggggggggtcgacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccactgtcta

SEQ ID NO: 563590 - DNA, 480 bp, Homo sapiens
  misc_feature: HIJSMM301DCW2G.17.39.D06.1.454.light.4.raw
cgtagactagcacgaccggtgctcgatttagtgacatctcgcagttctttggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttggcagcaacttagcctggtatcagcagaaacctggccaggctcccaggctcctcatgtatggtgcatctaccagggccactggtgtcccagccaggttcagtggcagtgggtctgggacagagttctctctcatcatcagcagcctgcagtctgaagattttgcggtttattactgtcagcagtataatcagtggcctccgtggacgttcggcaagggaccaaggtggaatacaaacgaactagtgg

SEQ ID NO: 563591 - DNA, 495 bp, Homo sapiens
  misc_feature: HIJSMM301BBPA3.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatcgtgggacagtatttcactctcaccgtcagcagtctgcaacctgaagtattttgctaacttactactgtcaacagaagttacacgtacccccctctaccttcggcggacggacgaaggcggagatcagacgaactgtgctgcaccatctgtcttcta

SEQ ID NO: 563592 - DNA, 494 bp, Homo sapiens; identical to SEQ ID NO: 535629
  misc_feature: HIJSMM301EE5HQ.4.27.C05.1.454.light.4.raw

SEQ ID NO: 563593 - DNA, 486 bp, Homo sapiens
  misc_feature: HIJSMM301ESQSJ.48.1.A01.1.454.light.4.raw
agtatacatacacgaccggtgctcgatttagacgtctcatcagggggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggaccttcggtccaggaccgaggtggaaagtacaaacgaactagtggctgcaccatctgtctt

SEQ ID NO: 563594 - DNA, 518 bp, Homo sapiens; identical to SEQ ID NO: 539372
  misc_feature: HIJSMM301EFAFV.7.86.H09.1.454.light.4.raw

SEQ ID NO: 563595 - DNA, 496 bp, Homo sapiens
  misc_feature: HIJSMM301AEHDW.18.11.A11.1.454.light.4.raw
tacgagtatgcacgaccggtgctcgatttagctacgactgcagggggcgagcaagatgggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgaactgtggctgcaccatctgtcttcatccttcccgccat

SEQ ID NO: 563596 - DNA, 498 bp, Homo sapiens
  misc_feature: HIJSMM301A93VI.11.74.G08.1.454.light.4.raw
cgagagataccacgaccggtgctcgatttagtagctctatcagggggggtcgtcaggaggcagcgctctcaggacgtcaccaccatggcctgggctctgctcctcctcagcctcctcactcagggcacagggtccgtgggcccagtctgccctgactcagcctccctccgcgtccgggtctcctggacagtcagtcaccatctcctgcactggaaccagcagtgacattggtggttataactatgtctcctggtaccaacaacacccagacaaagcccccaaactcatgatttatgaggtcactaagcggccctcaggggtccctgatcgcttctctggctccaagtctggcaacacggcctccctgaccgtctctgggctccaggctgacgatgaggctgattattattgcagctcatatgcaggcagcaccaatttggtgttcggcggagggaccaagctgaccgtcctaggtcagcccaaggctgccccctcggt

SEQ ID NO: 563597 - DNA, 488 bp, Homo sapiens; identical to SEQ ID NO: 542699
  misc_feature: HIJSMM301AW1MT.12.51.E07.1.454.light.4.raw

SEQ ID NO: 563598 - DNA, 486 bp, Homo sapiens
  misc_feature: HIJSMM301DNHO5.14.53.E09.1.454.light.4.raw
cgtctagtaccacgaccggtgctcgatttagagagagtgtgttgggtttgggggggagcctagctgtgctgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgctttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttatcgggtgttcggcggagggaccaagctgaccgtccta

SEQ ID NO: 563599 - DNA, 487 bp, Homo sapiens
  misc_feature: HIJSMM301BI5PM.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtggggtcccatcaaggttcagcggcagtgggtctgggacagaattcactctcaccatcagcagcctgcaacctgatgactttgcaacttattactgccaacagtataatggttatgaatccacttttgccaaggaccaagctggagatcaaacgaactgtggctgcacca

SEQ ID NO: 563600 - DNA, 494 bp, Homo sapiens; identical to SEQ ID NO: 539894
  misc_feature: HIJSMM301EWC59.16.53.E09.1.454.light.4.raw

SEQ ID NO: 563601 - DNA, 506 bp, Homo sapiens
  misc_feature: HIJSMM301A8TTT.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtaggaaagtcaaacgaactagtggctggcaccatctgtcttcatcttccccg

SEQ ID NO: 563602 - DNA, 494 bp, Homo sapiens
  misc_feature: HIJSMM301AG8FU.15.67.G01.1.454.light.4.raw
tctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagatttcactctcaccatcagcagcctgcagcctgaagatttcgcaacttattactgtctacaagattacaattaccctcggacgttcggtccacggggaccaacggtaggaagtacaaacgaactacgtggctgcacca

SEQ ID NO: 563603 - DNA, 474 bp, Homo sapiens
  misc_feature: HIJSMM301CD6LR.48.49.E05.1.454.light.4.raw
agtatacatacacgaccggtgctcgatttagagcgactagcaacacacaaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccttcgcttgccgggcaagtcaggacattaaaagtgatttaggctggtatcagcagaaaccagggaaagcccctaagctcctgatctatgctgcatccactttacaaagtggagtcccatcaaggttcagcggcagtggatctggcacagatttcactctcaccatcagcagcctgcagcctgaagattctgcaacttattactgtctacacgattacaattaccctgtacgttcggccaagggaccaaggtggaaatcaaacgaa

SEQ ID NO: 563604 - DNA, 504 bp, Homo sapiens; identical to SEQ ID NO: 535561
  misc_feature: HIJSMM301BZXKN.4.57.F02.1.454.light.4.raw

SEQ ID NO: 563605 - DNA, 494 bp, Homo sapiens; identical to SEQ ID NO: 558792
  misc_feature: HIJSMM301A0ZLX.10.79.H02.1.454.light.4.raw

SEQ ID NO: 563606 - DNA, 495 bp, Homo sapiens
  misc_feature: HIJSMM301DLMFI.5.12.B01.1.454.light.4.raw
atcagacacgcacgaccggtgctcgatttagtagtgtagattccgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaacagtgacattggtgcttatgactatgtctcgtggtatcaaaagtatccagacacagcccccaaactcatcctttatgatgtccgtgttcggccctcaggggtttctgttcgcttctctggctccaagtctggcagcacggcctccctgaccatctctgggctccaggctgaggacgaggctgactattattgcagttcatatggtagtatgaagactcttgtgattttcggcggagggaccaagctgaccgtcctgagtcagcccaaggctccg

SEQ ID NO: 563607 - DNA, 511 bp, Homo sapiens
  misc_feature: HIJSMM301C4D9Y.5.58.F03.1.454.light.4.raw
atcagacacgcacgaccggtgctcgatttagtctgatcgagaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcacacttttatgttcgggactgggaccaaggtcaccgtcctaggtcagcccaaggccaacccactgtcactctccg

SEQ ID NO: 563608 - DNA, 502 bp, Homo sapiens; identical to SEQ ID NO: 541501
  misc_feature: HIJSMM301BK7T3.17.27.C05.1.454.light.4.raw

SEQ ID NO: 563609 - DNA, 523 bp, Homo sapiens
  misc_feature: HIJSMM301CSZM7.40.46.E02.1.454.light.4.raw
tctagcgactcacgaccggtgctcgatttagactcatctacagggaaaggggagtctgggcctaaggaagcagcactggtggtgcctcagccatggcctggaccgttctcctcctcggcctcctctctcactgcacagggtctgtgacctcctatgtgctgactcagccactctcggtgtctgtggccccaggacaggcggccaatgttacctgtgggggagacaacattgggagtaaaagtgtgcactggtaccagctgaagccaggccaggcccctgtgttggtcgtctttggacatggtgcccgaccctcggggatccctgagcgattctctgcctccaggtctgggaacacggccaccctgaccatcaccagggtcgaggccggagatggaggccgactatttttgtcacgtgtggcacgttagtcatcacgtcttcggaactgggaccacggtcaccgtcctaagtcagcccaaggccaaccccactgtcactctcgttcccgccctcctcagtcgct

SEQ ID NO: 563610 - DNA, 496 bp, Homo sapiens; identical to SEQ ID NO: 535109
  misc_feature: HIJSMM301B3XE4.16.78.H01.1.454.light.4.raw

SEQ ID NO: 563611 - DNA, 508 bp, Homo sapiens
  misc_feature: HIJSMM301EXOKU.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagcaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaaaccggggatgaggccgactattactgtcaggtgtgggatagtagtggtgatcatccatacgtcttcggaactgggaccaaggtctccgtcctacgtcagcccaaggccaactccactgtcactctgttccca

SEQ ID NO: 563612 - DNA, 510 bp, Homo sapiens; identical to SEQ ID NO: 535474
  misc_feature: HIJSMM301BA5JM.17.33.C11.1.454.light.4.raw

SEQ ID NO: 563613 - DNA, 504 bp, Homo sapiens
  misc_feature: HIJSMM301CTHXI.2.76.G10.1.454.light.4.raw
  modified_base (465)..(465): a, c, t, g, unknown or other
acgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggcagagggtcaccatctcttgttctggaggcacctccaacatcgggcgtgataatgtgtactggtacaagcaggtcccaggaacgacccccaaactcctcatctctcacaataatcagcggccctcaggagtccctgaccgattctctgcctccaagtccggcacctcagcctccctggccatcagtgggcctccggggccgaggatgaggctgatttattactgtgcaggatgggatgacaacctgggtncttatctcttcggacctgggaccaaggtcaccgtctggt

SEQ ID NO: 563614 - DNA, 495 bp, Homo sapiens
  misc_feature: HIJSMM301DC6QG.53.11.A11.1.454.light.4.raw
cgcgtatacacacgaccggtgctcgatttagctacgactgcagggggtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggcaaaacaatatggatattggtaccggcagaagccaggccaggcccctgtgttggtaatatataaagacagggagaggcccccagggatccctgagcgatactctggctccagctcagggacaacagtcacattgaccatcagtggagtccaggcagaagacgaggctgactattactgtcaatctgcggacagcagtggttctcatgtggtattcggcggagggaccaagctgaccgtcctaggtcagcccaaggctgccccctcggcactctcg

SEQ ID NO: 563615 - DNA, 494 bp, Homo sapiens; identical to SEQ ID NO: 534992
  misc_feature: HIJSMM301D441C.9.1.A01.1.454.light.4.raw

SEQ ID NO: 563616 - DNA, 484 bp, Homo sapiens
  misc_feature: HIJSMM301CEMVF.51.6.A06.1.454.light.4.raw
cgatcgtatacacgaccggtgctcgatttagatctactgacaggggtggggagcctagctgtgctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgattctctggctccacctcagggacaatggtcacattgaccatcagtggagtccaggcagaagacgaggctgactatttctgtcaatcttcagacatcagtggtacttatgtcttcggaactgggaccaaggtcaccgtcctaggtcag

SEQ ID NO: 563617 - DNA, 494 bp, Homo sapiens; identical to SEQ ID NO: 534992
  misc_feature: HIJSMM301EXESL.9.1.A01.1.454.light.4.raw

SEQ ID NO: 563618 - DNA, 507 bp, Homo sapiens
  misc_feature: HIJSMM301DSOAT.19.78.H01.1.454.light.4.raw
tactctcgtgcacgaccggtgctcgatttagtgtgagtagtttgggtttgggggggtcgacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgcccatatgcaggtcgtatctcttatgtcttcggaactgggaccaaggtcaccgtcctaggtcagcccaaggccaacccactgtcact

SEQ ID NO: 563619 - DNA, 488 bp, Homo sapiens
  misc_feature: HIJSMM301B03N5.3.55.E11.1.454.light.4.raw
agacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtatcccagccaggttcagtggcagtgggtctgggacagagttcattctcaccatcagcagcctgcagtctgaagattttgcaatttattactgtcagcagtataataactggtggacgttcggccaagggaccaaggtagaaatacaaacgaactgtggctgcaccatctgt

SEQ ID NO: 563620 - DNA, 445 bp, Homo sapiens
  misc_feature: HIJSMM301CCK2I.17.21.B10.1.454.light.4.raw
cgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcagggtacactctggccgttcacttttggccaggggaccaaactggatatcagacgaactgtggctgcaccatctgtcttcatcttcccgccatcctgactagtctacg

SEQ ID NO: 563621 - DNA, 493 bp, Homo sapiens; identical to SEQ ID NO: 535047
  misc_feature: HIJSMM301CP379.16.53.E09.1.454.light.4.raw

SEQ ID NO: 563622 - DNA, 482 bp, Homo sapiens
  misc_feature: HIJSMM301BDBU9.43.12.B01.1.454.light.4.raw
tgtgagtagtcacgaccggtgctcgatttagtagtgtagattccgcgggggagtcagacacagtcaggacacagcatggacatgagggtccccgctcagctcctggggctcctgctgctctggttcccaggttccagatgcgacatccagctgacccagtctccatcttctgtgtctgcatctgtgggagacacagtcaccatcacttgtcgggcgagtcaagttattagtaactggttagcctggtatcagcagaaaccaggaaaagcccctaaactcctgatctatgctgcatccaggttgcagagtggggtcccatcaagattcagcggcagtggatctgggacagatttcactctcactatcagcagcctgcagcctgaagattttgccacttactattgtcaacaggctgacagtttcccccttcaccttcggccaagggacacgactggacattaaacgaactgtggctgcaccta

SEQ ID NO: 563623 - DNA, 488 bp, Homo sapiens; identical to SEQ ID NO: 535081
  misc_feature: HIJSMM301B1DQV.26.23.C01.1.454.light.4.raw

SEQ ID NO: 563624 - DNA, 492 bp, Homo sapiens; identical to SEQ ID NO: 534967
  misc_feature: HIJSMM301AWR9V.47.64.F09.1.454.light.4.raw

SEQ ID NO: 563625 - DNA, 476 bp, Homo sapiens
  misc_feature: HIJSMM301CQ752.40.1.A01.1.454.light.4.raw
tctagcgactcacgaccggtgctcgatttagacgtctcatcagggggagtcagtcccaaccaggacacagcatggacatgagggtccctgctcagctcctggggctcctgctgctctggctctcaggtgccagatgtgacatccagctgacccagtctccatcctccctgtctgcatctgttggagacagagtcaccatcacttgccaggcgagtcaggacattagtaaatatttgaattggtatcaacaaaaaccagggaaagcccctaagctcctgatctacgatgcatctaagttggaaacaggggtctcatcaaggttcagtggaagtggatctgggacagatcctactttcaccatcagcagcctgcagccagaagatattgcgacatatttctgtcaggtgtatgaaagtctccctgttttggtccaggggaccaaggtggaggatcaaacgaactagtggctgcaccat

SEQ ID NO: 563626 - DNA, 455 bp, Homo sapiens
  misc_feature: HIJSMM301C4ED6.19.86.H09.1.454.light.4.raw
tactctcgtgcacgaccggtgctcgatttagtgctatagacttgggtttgggggccggttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccgccctcctccacgagagta

SEQ ID NO: 563627 - DNA, 512 bp, Homo sapiens
  misc_feature: HIJSMM301B7WFC.43.59.F04.1.454.light.4.raw
tgtgagtagtcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaagcccccaaactcttgatttatgatgtcacttatcggccctcaggggtttcttatcgcttctctggctccaagtctggcaacacggcctccctgaccatctctgggctccaggctgaggacgaggctgattattactgcaactcacttacaacgaccgacacttgcgtattcggcggcgggaccaagctgaccgtcctaggtcagcccaaggctgccccctcggtcactc

SEQ ID NO: 563628 - DNA, 495 bp, Homo sapiens; identical to SEQ ID NO: 554164
  misc_feature: HIJSMM301A39NW.27.78.H01.1.454.light.4.raw

SEQ ID NO: 563629 - DNA, 505 bp, Homo sapiens
  misc_feature: HIJSMM301BWD7H.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaacgacccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccaaactgaccgtcctaggtcagcccaaggctcgccccctc

SEQ ID NO: 563630 - DNA, 508 bp, Homo sapiens
  misc_feature: HIJSMM301D06FZ.10.88.H11.1.454.light.4.raw
catagtagtgcacgaccggtgctcgatttagcgacagcgagaacacacaaagggggaggaactgctcagttaggacccagagggaaccatggaagccccagctcagcttctcttcctcctgctactctggctcccaggtaccaaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcagtgggtctgggacagacttcactctcaccatcagcagcctggagcctgaagatattgcagtttattattgtcagcagcgtagcaggtggcctttcactttcggcccggggaccaaagtggaaatcaaacgaactgtggctgcaccatctgtcttcatcttcccgcc

SEQ ID NO: 563631 - DNA, 497 bp, Homo sapiens
  misc_feature: HIJSMM301DL19B.41.71.G05.1.454.light.4.raw
tctatactatcacgaccggtgctcgatttagtgtcgtcgcaagagagaggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcaggttattaataattggttggcctggtatcagcagaaaccagggaaagcccctaaactcctgatctataaggcgtctactttagagagtggggtcccttcaaggttcagtggcagtggatctgggacagagttcaccctcaccatcggcagcctgcagcctgaagatatcgcaacttattactgtcaacaatataacacttattcaggggcattcggccaagggccaaggtgaaattaacgaactgtggctgcaccatctgtcttcatcttccg

SEQ ID NO: 563632 - DNA, 444 bp, Homo sapiens; identical to SEQ ID NO: 535192
  misc_feature: HIJSMM301D43RC.5.9.A09.1.454.light.4.raw

SEQ ID NO: 563633 - DNA, 486 bp, Homo sapiens
  misc_feature: HIJSMM301DQ3DJ.43.33.C11.1.454.light.4.raw
tgtgagtagtcacgaccggtgctcgatttagagtgagctcgttgggtttgggggcagaagtctctctcagtcaggacacagcatggacatgagggtccctgctcagctcctgggactcctgctgctctggctcccagcagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagattttctctcgtcatcactggtctacagtctgacgacggcgcaatgtacttctgtcaacactatgcctctccccctacaattcggtcaggggaccaagttgaacatcaatcgaactgtggctgcacc

SEQ ID NO: 563634 - DNA, 506 bp, Homo sapiens
  misc_feature: HIJSMM301C6HHF.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcggccaagggaccgaaggtaggaaatcaaacgaactagtggctgcaccatctgtcttcatcttccccg

SEQ ID NO: 563635 - DNA, 498 bp, Homo sapiens
  misc_feature: HIJSMM301DV83Z.40.4.A04.1.454.light.4.raw
tctagcgactcacgaccggtgctcgatttagagtagtgatcagggggaactgagctacaacaggcaggcaggggcagcaagatggtgttgcagacccaggtcttcatttctctgttcctctggatctctggtgccttcggggacatcgtgatgacccagtctccagactccctggctctgtctctgggcgagagggccaccatcaactgcaagtccagccagagcgttttatccacttcctacaatcagaattacttagcttggtatcagcataaaccagggcagcctccgaggctgctcatttactggacatctatccgggaatccgggggtccctgaccgattccgtggcagtgggtctgggacagattttactctcaccatcaccagccttcaggctgaagatgtggcagtttattactgtcaccaatatttagacattcctccgacgttcggccaagggaccaaggtggagatcaaacgaactgtggctgcacc

SEQ ID NO: 563636 - DNA, 494 bp, Homo sapiens; identical to SEQ ID NO: 534994
  misc_feature: HIJSMM301CC3Y7.27.78.H01.1.454.light.4.raw

SEQ ID NO: 563637 - DNA, 486 bp, Homo sapiens; identical to SEQ ID NO: 543543
  misc_feature: HIJSMM301BUGOB.49.3.A03.1.454.light.4.raw

SEQ ID NO: 563638 - DNA, 473 bp, Homo sapiens
  misc_feature: HIJSMM301BLSEC.13.76.G10.1.454.light.4.raw
tcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcaccgtctaagtcacg

SEQ ID NO: 563639 - DNA, 483 bp, Homo sapiens; identical to SEQ ID NO: 537371
  misc_feature: HIJSMM301DM4K2.13.55.E11.1.454.light.4.raw

SEQ ID NO: 563640 - DNA, 497 bp, Homo sapiens
  misc_feature: HIJSMM301CVDS9.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtggggtctgggacagacttcactctcaccatcagcagactggagcctgaggattttgctagtgtattactgtcagcagtatcataggtcaaacaccttcggcccaagggacacgactggagattaaaggaactgtggctgcaccatctgtcttcatcttccccg

SEQ ID NO: 563641 - DNA, 532 bp, Homo sapiens
  misc_feature: HIJSMM301APVQK.13.73.G07.1.454.light.4.raw
tcacgtactacacgaccggtgctcgatttagctctacgctcgaggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaacacccaggcaaagcccccaaactcattatttacggggtcaataagcggccctcagggctttctgatcgcttctctggctccaagtctggcaacacggcctccctgacaatctctggactccaggccgaggacgaggctgatttttactgttgttcatatgcagggaaggagtgattatgtctttggaagtggtacgaaccgtaggtcctaccgttccgttggtcaccgacccgaacggaccccaacccctactcgtaccacttctccgtt

SEQ ID NO: 563642 - DNA, 470 bp, Homo sapiens
  misc_feature: HIJSMM301EC92P.49.45.E01.1.454.light.4.raw
agtcgagagacacgaccggtgctcgatttagtgagtcagtaagggaaagggggagtcagtcccaaccaggacacagcatggacatgagggtccctgctcagctcctggggctcctgctgctctggctctcaggtgccagatgtgtcatccagatgacccagtctccttcctccctgtctgcatctataggagacagaatcaccatcacttgccgggcgagtcgagacattagcatgtatctgaattggtatcagcaaaaaccagggacagcccctaaactcctgatcctcgatgcatccactttggagacaggggtcccatcaaggttcagtggaagtggctctgggacagtattttactttctaccatcagcaggctgcagcctgaagatattgcaacatattactgtcaacagtatgatcgtctcccgctcactttcggcggggggaccgaggtggagatcaagcgaa

SEQ ID NO: 563643 - DNA, 494 bp, Homo sapiens; identical to SEQ ID NO: 535680
  misc_feature: HIJSMM301CH23M.16.78.H01.1.454.light.4.raw

SEQ ID NO: 563644 - DNA, 489 bp, Homo sapiens
  misc_feature: HIJSMM301EF0KU.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaagggaccaaagtggacatcaagcgaactgtggctgcacatctgt

SEQ ID NO: 563645 - DNA, 490 bp, Homo sapiens
  misc_feature: HIJSMM301EP776.49.28.C06.1.454.light.4.raw
agtcgagagacacgaccggtgctcgatttagagctcacgtattgggtttgggggaggaactgctcagttaggacccagacggaaccatggaagccccagcgcagcttctcttcctcctgctactctggctcccagataccactggagaaatagtgatgacgcagtctccagccaccctgtctgtgtctccagggggaaagagtcaccctctcctgcagggccagtcagagtgttaggagcaacttagcctggtatcagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataatgtccgggctccggacactttcggcggagggaccaaggtggagatcaaacgaactgtggctgcaccat

SEQ ID NO: 563646 - DNA, 511 bp, Homo sapiens; identical to SEQ ID NO: 537464
  misc_feature: HIJSMM301BB1HP.7.34.D01.1.454.light.4.raw

SEQ ID NO: 563647 - DNA, 479 bp, Homo sapiens; identical to SEQ ID NO: 545213
  misc_feature: HIJSMM301BZX4F.40.59.F04.1.454.light.4.raw
